US012544458B2

(12) United States Patent
Altshuler et al.

(10) Patent No.: US 12,544,458 B2
(45) Date of Patent: Feb. 10, 2026

(54) PAH-MODULATING COMPOSITIONS AND METHODS

(71) Applicant: Flagship Pioneering Innovations VI, LLC, Cambridge, MA (US)

(72) Inventors: Robert Charles Altshuler, Newton, MA (US); Anne Helen Bothmer, Cambridge, MA (US); Daniel Raymond Chee, Cambridge, MA (US); Cecilia Giovanna Silvia Cotta-Ramusino, Cambridge, MA (US); Kyusik Kim, Worcester, MA (US); Randi Michelle Kotlar, Arlington, MA (US); Gregory David McAllister, Cambridge, MA (US); Ananya Ray, Melrose, MA (US); Nathaniel Roquet, Philadelphia, PA (US); Carlos Sanchez, Boston, MA (US); Barrett Ethan Steinberg, Somerville, MA (US); William Edward Salomon, West Roxbury, MA (US); Robert James Citorik, Somerville, MA (US); William Querbes, Cambridge, MA (US); Luciano Henrique Apponi, Cambridge, MA (US); Zhan Wang, Cambridge, MA (US)

(73) Assignee: Flagship Pioneering Innovations VI, LLC, Cambridge, MA (US)

( * ) Notice: Subject to any disclaimer, the term of this patent is extended or adjusted under 35 U.S.C. 154(b) by 0 days.

(21) Appl. No.: 18/495,276

(22) Filed: Oct. 26, 2023

(65) Prior Publication Data

US 2024/0082429 A1 Mar. 14, 2024

Related U.S. Application Data

(63) Continuation of application No. PCT/US2022/076058, filed on Sep. 7, 2022.

(60) Provisional application No. 63/367,025, filed on Jun. 24, 2022, provisional application No. 63/303,927, filed on Jan. 27, 2022, provisional application No. 63/241,897, filed on Sep. 8, 2021.

(51) Int. Cl.

| | |
|---|---|
| ***A61K 48/00*** | (2006.01) |
| ***A61P 3/00*** | (2006.01) |
| ***C12N 9/22*** | (2006.01) |
| ***C12N 15/11*** | (2006.01) |

(52) U.S. Cl.

CPC .............. *A61K 48/005* (2013.01); *A61P 3/00* (2018.01); *C12N 9/22* (2013.01); *C12N 15/11* (2013.01)

(58) Field of Classification Search

None

See application file for complete search history.

(56) References Cited

U.S. PATENT DOCUMENTS

| | | | | |
|---|---|---|---|---|
| 10,676,734 | B2 * | 6/2020 | Tang | C12N 15/1065 |
| 11,447,770 | B1 | 9/2022 | Liu et al. | |
| 12,024,728 | B2 | 7/2024 | Altshuler et al. | |
| 12,031,162 | B2 | 7/2024 | Altshuler et al. | |
| 12,037,602 | B2 | 7/2024 | Cleaver et al. | |
| 12,037,617 | B2 | 7/2024 | Altshuler et al. | |
| 12,065,669 | B2 | 8/2024 | Cleaver et al. | |
| 12,123,034 | B2 | 10/2024 | Altshuler et al. | |
| 12,157,898 | B2 | 12/2024 | Bothmer et al. | |
| 12,270,029 | B2 | 4/2025 | Altshuler et al. | |
| 2019/0169639 | A1 | 6/2019 | Zhang et al. | |
| 2020/0109398 | A1 | 4/2020 | Rubens et al. | |
| 2020/0268906 | A1 | 8/2020 | Finn et al. | |
| 2021/0077594 | A1 | 3/2021 | In et al. | |
| 2021/0261957 | A1 * | 8/2021 | Petris | C12N 15/113 |
| 2021/0393804 | A1 * | 12/2021 | Wright | C07K 14/005 |
| 2022/0396813 | A1 | 12/2022 | Feala et al. | |
| 2023/0131847 | A1 | 4/2023 | Rubens et al. | |
| 2023/0235358 | A1 | 7/2023 | Citorik et al. | |
| 2023/0242899 | A1 | 8/2023 | Steinberg et al. | |
| 2023/0272430 | A1 | 8/2023 | Bothmer et al. | |
| 2023/0332184 | A1 | 10/2023 | Rubens et al. | |
| 2023/0348939 | A1 | 11/2023 | Bothmer et al. | |
| 2024/0002822 | A1 | 1/2024 | Altshuler et al. | |
| 2024/0002886 | A1 | 1/2024 | Altshuler et al. | |
| 2024/0018551 | A1 | 1/2024 | Altshuler et al. | |
| 2024/0026324 | A1 | 1/2024 | Altshuler et al. | |
| 2024/0035049 | A1 | 2/2024 | Bothmer et al. | |
| 2024/0042058 | A1 | 2/2024 | Citorik et al. | |

(Continued)

FOREIGN PATENT DOCUMENTS

| | | | | |
|---|---|---|---|---|
| CN | 107723358 A * | 2/2018 | C12Q 1/6872 |
| WO | WO-2013169398 A2 * | 11/2013 | C12N 9/22 |

(Continued)

OTHER PUBLICATIONS

Nishimasu et al. Crystal Structure of Cas9 in Complex with Guide RNA and Target DNA. Cell 156, 935-949, Feb. 27, 2014 (Year: 2014).*

(Continued)

*Primary Examiner* — Jennifer Dunston

*Assistant Examiner* — Tiffany Nicole Grooms

(74) *Attorney, Agent, or Firm* — K&L Gates LLP

(57) ABSTRACT

The disclosure provides, e.g., compositions, systems, and methods for targeting, editing, modifying, or manipulating a host cell's genome at one or more locations in a DNA sequence in a cell, tissue, or subject. Gene modifying systems for treating phenylketonuria (PKU) are described.

28 Claims, 42 Drawing Sheets

Specification includes a Sequence Listing.

(56) References Cited

U.S. PATENT DOCUMENTS

| | | | |
|---|---|---|---|
| 2024/0076638 | A1 | 3/2024 | Altshuler et al. |
| 2024/0076698 | A1 | 3/2024 | Cleaver et al. |
| 2024/0082429 | A1 | 3/2024 | Altshuler et al. |
| 2024/0084333 | A1 | 3/2024 | Cleaver et al. |
| 2024/0084334 | A1 | 3/2024 | Altshuler et al. |
| 2024/0093186 | A1 | 3/2024 | Altshuler et al. |
| 2024/0200104 | A1 | 6/2024 | Citorik et al. |
| 2024/0247243 | A1 | 7/2024 | Altshuler et al. |
| 2024/0252682 | A1 | 8/2024 | Altshuler et al. |
| 2024/0263153 | A1 | 8/2024 | Rubens et al. |
| 2024/0318170 | A1 | 9/2024 | Rubens et al. |
| 2024/0374759 | A1 | 11/2024 | Altshuler et al. |
| 2024/0417757 | A1 | 12/2024 | Bothmer et al. |

FOREIGN PATENT DOCUMENTS

| | | | | |
|---|---|---|---|---|
| WO | 2019040650 | A1 | 2/2019 | |
| WO | 2020191233 | A1 | 9/2020 | |
| WO | 2020191234 | A1 | 9/2020 | |
| WO | 2020191242 | A1 | 9/2020 | |
| WO | 2020191248 | A1 | 9/2020 | |
| WO | 2020191249 | A1 | 9/2020 | |
| WO | WO-2020191153 | A2 * | 9/2020 | ............ A61K 38/45 |
| WO | 2021062410 | A2 | 4/2021 | |
| WO | 2021138469 | A1 | 7/2021 | |
| WO | 2021226558 | A1 | 11/2021 | |
| WO | 2022150790 | A2 | 7/2022 | |
| WO | 2022173830 | A1 | 8/2022 | |
| WO | 2022212926 | A1 | 10/2022 | |
| WO | 2022256714 | A2 | 12/2022 | |
| WO | 2023004439 | A2 | 1/2023 | |
| WO | 2023283092 | A1 | 1/2023 | |
| WO | 2023015309 | A2 | 2/2023 | |
| WO | 2023015318 | A2 | 2/2023 | |
| WO | 2023070062 | A2 | 4/2023 | |
| WO | 2023086389 | A1 | 5/2023 | |
| WO | 2023086558 | A1 | 5/2023 | |
| WO | 2023086842 | A1 | 5/2023 | |
| WO | 2023096847 | A2 | 6/2023 | |
| WO | 2023096977 | A2 | 6/2023 | |
| WO | 2023192655 | A2 | 10/2023 | |

OTHER PUBLICATIONS

U.S. Appl. No. 18/467,428, filed Sep. 14, 2023, Flagship Pioneering Innovations VI, LLC.
U.S. Appl. No. 18/282,644, filed Sep. 18, 2023, Flagship Pioneering Innovations VI, LLC.
U.S. Appl. No. 18/280,749, filed Sep. 7, 2023, Flagship Pioneering Innovations VI, LLC.
U.S. Appl. No. 18/563,127, filed Nov. 21, 2023, Flagship Pioneering Innovations VI, LLC.
U.S. Appl. No. 18/469,344, filed Sep. 18, 2023, Flagship Pioneering Innovations VI, LLC.
U.S. Appl. No. 18/470,687, filed Sep. 20, 2023, Flagship Pioneering Innovations VI, LLC.
U.S. Appl. No. 18/590,275, filed Feb. 28, 2024, Flagship Pioneering Innovations VI, LLC.
U.S. Appl. No. 18/690,120, filed Mar. 7, 2024, Flagship Pioneering Innovations VI, LLC.
U.S. Appl. No. 18/690,134, filed Mar. 7, 2024, Flagship Pioneering Innovations VI, LLC.
Banerjee et al., "Hematopoietic stem cells and retroviral infection," Retrovirology (2010) vol. 7, No. 1, pp. 8.
Breda et al., "In Vivo Modification of Hematopoietic Stem Cells by Targeted Lipid Nanoparticles Encapsulating mRNA," Blood (2022) vol. 140, No. Supplement 1, pp. 305-306.
Chu et al., "Rationally Designed Base Editors for Precise Editing of the Sickle Cell Disease Mutation," The CRISPR Journal (2021) vol. 4, No. 2, pp. 169-177.
Crossley et al., "Effective therapies for sickle cell disease: are we there yet?," Trends in Genetics (2022) vol. 38, No. 12, pp. 1284-1298.
Dever et al., "CRISPR/Cas9 β-globin gene targeting in human haematopoietic stem cells," Nature (2016) vol. 539, No. 7629, pp. 384-389.
Everette et al., "Ex vivo prime editing of patient haematopoietic stem cells rescues sickle-cell disease phenotypes after engraftment in mice," Nature Biomedical Engineering (2023) vol. 7, No. 5, pp. 616-628.
Fiumara et al., "Genotoxic effects of base and prime editing in human hematopoietic stem cells," Nature Biotechnology (2023) vol. No. , pp. 1-15.
Gao et al.,"A truncated reverse transcriptase enhances prime editing by split AAV vectors," bioRxiv (2021) vol. No. , pp. 2021.11.05. 467423.
George et al., "Efficient and error-free correction of sickle mutation in human erythroid cells using prime editor-2," Frontiers in Genome Editing (2022) vol. 4, No. , pp. 1085111.
Geurts et al., "Evaluating CRISPR-based prime editing for cancer modeling and CFTR repair in organoids," Life Science Alliance (2021) vol. 4, No. 10, pp. e202000940.
Harrison et al., "CFTR RNA- and DNA-based therapies," Current Opinion in Pharmacology (2022) vol. 65, No. , pp. 102247.
International Search Report and Written Opinion for PCT/US2022/076058 mailed May 10, 2023, 14 pages.
Kanter et al., "Biologic and Clinical Efficacy of LentiGlobin for Sickle Cell Disease," New England Journal of Medicine (2021) vol. 386, No. 7, pp. 617-628.
King et al., "Correction of Airway Stem Cells: Genome Editing Approaches for the Treatment of Cystic Fibrosis," Human Gene Therapy (2020) vol. 31, No. 17-18, pp. 956-972.
Kleinstiver et al., "Engineered CRISPR-Cas9 nucleases with altered PAM specificities," Nature (2015) vol. 523, No. 7561, pp. 481-485.
Kweon et al., "Engineered prime editors with PAM flexibility," Molecular Therapy (2021) vol. 29, No. 6, pp. 2001-2007.
Levesque et al., "Nucleotide metabolism constrains prime editing in hematopoietic stem and progenitor cells," bioRxiv (2023) vol. No. , pp. 2023.10.22.563434.
Li et al., "In vivo HSC prime editing rescues sickle cell disease in a mouse model," Blood (2023) vol. 141, No. 17, pp. 2085-2099.
Li et al., "Prime editing-mediated correction of the CFTR W1282X mutation in iPSCs and derived airway epithelial cells," PLOS One (2023) vol. 18, No. 11, pp. e0295009.
Lieber et al.,"Prospects and challenges of in vivo hematopoietic stem cell genome editing for hemoglobinopathies," Molecular Therapy (2023) vol. 31, No. 10, pp. 2823-2825.
Liu et al., "A split prime editor with untethered reverse transcriptase and circular RNA template," Nature Biotechnology (2022) vol. 40, No. 9, pp. 1388-1393.
Newby et al., "Base editing of haematopoietic stem cells rescues sickle cell disease in mice," Nature (2021) vol. 595, No. 7866, pp. 295-302.
Ponnienselvan et al., "Addressing the dNTP bottleneck restricting prime editing activity," bioRxiv (2023) vol. No. , pp. 2023.10.21. 563443.
Ramadier et al., "Combination of lentiviral and genome editing technologies for the treatment of sickle cell disease," Molecular Therapy (2022) vol. 30, No. 1, pp. 145-163.
Remih et al.,"Alpha1-antitrypsin deficiency: New therapies on the horizon," Current Opinion in Pharmacology (2021) vol. 59, No. , pp. 149-156.
Walton et al., "Unconstrained genome targeting with near-PAMless engineered CRISPR-Cas9 variants," Science (2020) vol. 368, No. 6488, pp. 290-296.
Wolff et al., "Prime editing in hematopoietic stem cells—From ex vivo to in vivo CRISPR-based treatment of blood disorders," Frontiers in Genome Editing (2023) vol. 5, No. , pp. 1148650.
Wu et al.,"Highly efficient therapeutic gene editing of human hematopoietic stem cells," Nature Medicine (2019) vol. 25, No. 5, pp. 776-783.
Yasukawa et al., "Comparison of the Thermal Stabilities of Reverse Transcriptases from Avian Myeloblastosis Virus and Moloney Murine Leukaemia Virus," Journal of Biochemistry (2007) vol. 143, No. 2, pp. 261-268.

(56) References Cited

OTHER PUBLICATIONS

Zhang et al., "Catalytic-state structure and engineering of *Streptococcus thermophilus* Cas9," Nature Catalysis (2020) vol. 3, No. 10, pp. 813-823.

Zheng et al., "A flexible split prime editor using truncated reverse transcriptase improves dual-AAV delivery in mouse liver," Molecular Therapy (2022) vol. 30, No. 3, pp. 1343-1351.

U.S. Appl. No. 18/623,612, filed Apr. 1, 2024, Flagship Pioneering Innovations VI, LLC.

U.S. Appl. No. 18/595,904, filed Mar. 5, 2024, Flagship Pioneering Innovations VI, LLC.

U.S. Appl. No. 19/119,200, filed Oct. 25, 2024, Flagship Pioneering Innovations VI, LLC.

Anzalone et al., "Programmable large DNA deletion, replacement, integration, and inversion with twin prime editing and site-specific recombinases," bioRxiv (2021) retrieved from biorxiv.org/content/10.1101/2021.11.01.466790v1.full. pdf, 51 pages.

Anzalone et al., "Search-and replace genome editing without double-strand breaks or donor DNA," Nature (2019) vol. 576, No. 7785, pp. 149-157 and Supplementary Materials.

Böck et al., "In vivo prime editing of a metabolic liver disease in mice," Science Translational Medicine (2021) vol. 14, No. 636, Article eabl19238, 26 pages and Supplementary materials.

Harding et al., "Prospects for Cell-Directed Curative Therapy of Phenylketonuria (PKU)," Mol Front J (2019) vol. 3, No. 2, pp. 110-121.

Hillert et al., "The Genetic Landscape and Epidemiology of Phenylketonuria," The American Journal of Human Genetics (2020) vol. 107, pp. 234-250.

Kaiser et al., "Development of a porcine model of phenylketonuria with a humanized R408W mutation for gene editing," PLOS One (2021) vol. 16, No. 1, Artcle e0245831, 18 pages.

Pan et al., "CRISPR RNA-guided FokI nucleases repair a PAH variant in a phenylkeonuria model," Sci Rep (2016) vol. 6, Article 35794, 7 pages.

Vonanda et al., "Therapeutic liver repopulation by transient acetominophen selection of gene-modified hepatyocytes," Sci Transl Med (2021) vol. 13, Article eabg3047, 9 pages.

* cited by examiner

Nick

Ile Pro Arg Pro

| | | | | | | | | | | | | | | | | |
|---|---|---|---|---|---|---|---|---|---|---|---|---|---|---|---|---|
| **Reference** | A | T | A | C | C | T | T | G | G | C | **C** | **C** | **T** | T | C | T |
| sub0 | A | T | A | C | C | T | C | G | G | C | C | C | T | T | C | T |
| sub1 | A | T | A | C | C | G | C | G | G | C | C | C | T | T | C | T |
| sub2 | A | T | C | C | C | T | C | G | G | C | C | C | T | T | C | T |
| sub4 | A | T | A | C | C | T | C | G | C | C | C | C | T | T | C | T |
| sub7 | A | T | A | C | C | G | C | G | C | C | C | C | T | T | C | T |
| sub8 | A | T | A | C | C | G | C | G | C | C | C | A | T | T | C | T |

Nick

| | Pro | | | Arg | | | Pro | | | Phe | | |
|---|---|---|---|---|---|---|---|---|---|---|---|---|
| **Reference** | C | C | T | T | G | G | **C** | **C** | **C** | T | T | C |
| sub0 | C | C | T | C | G | G | C | C | C | T | T | C |
| sub1 | C | C | G | C | G | G | C | C | C | T | T | C |
| sub4 | C | C | T | C | G | C | C | C | C | T | T | C |
| sub5 | C | C | T | C | G | C | C | C | A | T | T | C |
| sub7 | C | C | G | C | G | C | C | C | C | T | T | C |
| sub8 | C | C | G | C | G | C | C | C | A | T | T | C |

Nick

| | Thr | | | Ile | | | Pro | | | Arg | | |
|---|---|---|---|---|---|---|---|---|---|---|---|---|
| **Reference** | A | C | A | A | T | A | **C** | **C** | **T** | T | G | G |
| sub0 | A | C | A | A | T | A | C | C | T | C | G | G |
| sub1 | A | C | A | A | T | A | C | C | G | C | G | G |
| sub2 | A | C | A | A | T | C | C | C | T | C | G | G |
| sub3 | A | C | A | A | T | C | C | C | G | C | G | G |
| sub4 | A | C | A | A | T | A | C | C | T | C | G | C |
| sub7 | A | C | G | A | T | A | C | C | T | C | G | G |

Nick

Pro Arg Pro

| Reference | G | G | G | C | C | A | A | G | G |
|---|---|---|---|---|---|---|---|---|---|
| sub0 | G | G | G | C | C | G | A | G | G |
| sub1 | G | G | G | C | C | G | G | G | G |
| sub4 | C | G | G | C | C | G | G | G | G |
| sub5 | C | G | G | A | C | G | G | G | G |
| sub6 | G | G | G | C | C | G | C | G | G |
| sub7 | G | G | G | A | C | G | C | G | G |

PAH-MODULATING COMPOSITIONS AND METHODS

CROSS REFERENCE TO RELATED APPLICATIONS

This application is a continuation of PCT/US2022/076058, filed Sep. 7, 2022, which claims the benefit of U.S. Provisional Application No. 63/241,897, filed Sep. 8, 2021, U.S. Provisional Application No. 63/303,927, filed Jan. 27, 2022, and U.S. Provisional Application No. 63/367,025, filed Jun. 24, 2022. The contents of the aforementioned applications are hereby incorporated by reference in their entirety.

SEQUENCE LISTING

The instant application contains a Sequence Listing which has been submitted electronically in XML, format compliant with WIPO Standard ST.26 and is hereby incorporated by reference in its entirety. Said XML copy, created on Sep. 15, 2023, is named V2065-702520FT_SL.xml and is 51,647,577 bytes in size.

BACKGROUND

Integration of a nucleic acid of interest into a genome occurs at low frequency and with little site specificity, in the absence of a specialized protein to promote the insertion event. Some existing approaches, like CRISPR/Cas9, are more suited for small edits that rely on host repair pathways, and are less effective at integrating longer sequences. Other existing approaches, like Cre/loxP, require a first step of inserting a loxP site into the genome and then a second step of inserting a sequence of interest into the loxP site. There is a need in the art for improved compositions (e.g., proteins and nucleic acids) and methods for inserting, altering, or deleting sequences of interest in a genome.

PKU is an inherited disorder involving an autosomal recessive inborn error of metabolism caused by a deficiency in the hepatic enzyme PAH. PAH catalyzes the hydroxylation of phenylalanine to tyrosine, the rate-limiting step in phenylalanine metabolism. The reaction is dependent on tetrahydrobiopterin (BH4), as a cofactor, molecular oxygen, and iron. Loss-of-function mutations in one, or both, copies of the PAH gene lead to a non-functional, or less efficient enzyme. This ultimately results in phenotypically severe forms of PKU where phenylalanine in the blood can accumulate to toxic concentrations, with impaired levels of plasma tyrosine. Additionally, the deficiency prevents normal synthesis of downstream products, including dopamine, norepinephrine, and melanin.

The PAH genomic sequence and its flanking regions span about 171 kb, containing 13 exons. Study of pathogenic allelic variants have identified more than 500 different disease-causing mutations in the PAH gene (Mitchell, et al. *Genet Med.* 2011; 13:697-707). Of these mutations, approximately 62% have been characterized as missense, 13% deletions, 11% splice, 6% silent, 5% nonsense, 2% insertion, and <1% deletion or duplication of exons. The identification of several PAH mutations have been described for their effects on enzymatic activity using enzyme kinetics and crystallographic studies. Mutations affecting the catalytic binding mode, including Y138F, S23A, and Y377F, were observed with reduced propensity for tetramer formation (Flydal, et al. *PNAS.* 2019; 116(23):11229-34). Other residues that interact with $BH_4$ in the precatalytic conformation (amino acids 245-255, 286, 322, and 325) also interact with $BH_4$ in the catalytic conformation, and, in addition, these sites are actually associated with severe destabilization of PAH.

Naturally occurring N-terminal PAH mutations have been determined to be distributed in a nonrandom pattern, clustering within residues 46-48 (GAL motif) and 65-69 (IESRP motif (SEQ ID NO: 37634)), both motifs highly conserved in pyruvate dehydrogenase (PDH) (Gjetting, et al. *Am./J. Hum. Genet.* 2001; 68:1353-60). Structure-function studies demonstrated that mutations in these regions drastically reduced phenylalanine binding. Most missense mutations identified in PKU to date result in phenotypic outcomes associated with misfolding of the PAH enzyme, increased protein turnover, and loss of enzymatic function. Residues in exons 7-9 and in interdomain regions within the subunit appear to play an important structural role and constitute hotspots for destabilization. Additionally, using recombinant forms of hPAH, mutations in $BH_4$ responsive domains, including R408W and Y414C showed residual activity, but had perturbed allostery suggesting altered protein conformation (Gersting, et al. *Hum. Genet.* 2008; 83:5-17). Mutation analyses and structure-function analyses have identified a robust genotype-phenotype mapping for PAH's role in PKU; however, outside of lifetime symptom management strategies, there has not been a successful cure.

Dietary therapy of phenylalanine (Phe) remains to be the mainstay treatment for PKU since its introduction in 1953. In the 1970s, tetrahydrobiopterin ($BH_4$) and neurotransmitter precursor (L-dopa/carbidopa and 5-hydroxytryptophan) combination therapy showed promise in modulating PKU. Since its institution as a therapy, synthetics such as sapropterin have been formulated for as small molecule isomers of $BH_4$. Although, this form of therapy is generally only useful in patients with mild subsets of PAH-deficient PKU. It is thought that the therapy responsiveness is associated with mutations in the PAH gene resulting in some residual enzyme activity. At high blood concentrations, Phe in the blood will compete with other large neutral amino acids (LNAAs) for transport across the blood-brain barrier. LNAA supplementation has been shown to reduce cerebral Phe concentrations despite the observed increase in plasma Phe levels. Likewise, dietary supplementation with glycomacropeptides (GMP) has been observed to significantly reduce ureagenesis, improved protein retention, and Phe utilization. Although, these strategies do little to address the increased blood levels of Phe or the genotypic drivers.

Modern non-dietary approaches include the development of PAH-based fusion proteins and enzyme substitution therapies. Enzyme substitution therapies can include administration of phenylalanine ammonia-lyase (PAL) to a patient. PAL is an enzyme which catalyzes the conversion of Phe to transcinnamic acid and insignificant amounts of ammonia. Early studies using PAL administered in enteric-coated gelatin capsules to PKU patients, showed reductions in Phe levels; however, repeated dosing in vivo resulted in mounting of immune responses. Although, these approaches are not practical from a clinical perspective as several intravenous injections would be required due to the limited half-life of circulating enzymes. Gene therapy has shown some promise, for example using viral vectors, in rescuing PAH functionality. However, the efficacy of this strategy is hampered by the very low gene transfer rate and transient transgene expression. Accordingly, there is a need for new and more effective treatments for targeting PAH in PKU.

SUMMARY OF THE INVENTION

This disclosure relates to novel compositions, systems, and methods for altering a genome at one or more locations in a host cell, tissue, or subject, in vivo or in vitro. The disclosure provides gene modifying systems that are capable of modulating (e.g., inserting, altering, or deleting sequences of interest) phenylalanine hydroxylase (PAH) activity and methods of treating phenylketonuria (PKU) by administering one or more such systems to alter a genomic sequence, such as to correct mutations, within the PAH gene on the human chromosome 12q23.2 involved as a genetic driver in PKU.

In one aspect, the disclosure relates to a system for modifying DNA to correct a human PAH gene mutation causing PKU comprising (a) a nucleic acid encoding a gene modifying polypeptide capable of target primed reverse transcription, the polypeptide comprising (i) a reverse transcriptase domain and (ii) a Cas9 nickase that binds DNA and has endonuclease activity, and (b) a template RNA comprising (i) a gRNA spacer that is complementary to a first portion of the human PAH gene, (ii) a gRNA scaffold that binds the polypeptide, (iii) a heterologous object sequence comprising a mutation region to correct the mutation, and (iv) a primer binding site (PBS) sequence comprising at least 3, 4, 5, 6, 7, or 8 bases of 100% homology to a target DNA strand at the 3' end of the template RNA. In some embodiments, the PAH gene may comprise a R408W mutation. In some embodiments, the PAH gene may comprise a R261Q mutation. In some embodiments, the PAH gene may comprise a R243Q mutation. In some embodiments, the PAH gene may comprise a IVS10-11G>A mutation. The template RNA sequence may comprise a sequence described herein, e.g., in Table 1A, 1B, 1C, 1D, 3A, 3B, 3C, 3D, 4A, 4B, 4C, 4D, 5A-5F, 8A-8D, E3, E3A, BB, E5, E5A, E6, or E6A.

The gRNA spacer may comprise at least 15 bases of 100% homology to the target DNA at the 5' end of the template RNA. The template RNA may further comprise a PBS sequence comprising at least 5 bases of at least 80% homology to the target DNA strand. The template RNA may comprise one or more chemical modifications.

The domains of the gene modifying polypeptide may be joined by a peptide linker. The polypeptide may comprise one or more peptide linkers. The gene modifying polypeptide may further comprise a nuclear localization signal. The polypeptide may comprise more than one nuclear localization signal, e.g., multiple adjacent nuclear localization signals or one or more nuclear localization signals in different regions of the polypeptide, e.g., one or more nuclear localization signals in the N-terminus of the polypeptide and one or more nuclear localization signals in the C-terminus of the polypeptide. The nucleic acid encoding the gene modifying polypeptide may encode one or more intein domains.

Introduction of the system into a target cell may result in insertion of at least 1, 2, 3, 4, 5, 10, 15, 20, 25, 30, 35, 40, 45, 50, 60, 70, 80, 90, 100, 150, 200, 250, 300, 350, 400, 500, or 1000 base pairs of exogenous DNA. Introduction of the system into a target cell may result in deletion, wherein the deletion is less than 2, 3, 4, 5, 10, 50, or 100 base pairs of genomic DNA upstream or downstream of the insertion. Introduction of the system into a target cell may result in substitution, e.g., substitution of 1, 2, or 3 nucleotides, e.g., consecutive nucleotides.

The heterologous object sequence may be at least 5, 10, 25, 50, 100, 150, 200, 250, 300, 400, 500, 600, or 700 base pairs.

In one aspect, the disclosure relates to a pharmaceutical composition comprising the system described above and a pharmaceutically acceptable excipient or carrier, wherein the pharmaceutically acceptable excipient or carrier is selected from the group consisting of a plasmid vector, a viral vector, a vesicle, and a lipid nanoparticle. In one aspect, the disclosure relates to a pharmaceutical composition comprising the system described above and multiple pharmaceutically acceptable excipients or carriers, wherein the pharmaceutically acceptable excipients or carriers are selected from the group consisting of a plasmid vector, a viral vector, a vesicle, and a lipid nanoparticle, e.g., where the system described above is delivered by two distinct excipients or carriers, e.g., two lipid nanoparticles, two viral vectors, or one lipid nanoparticle and one viral vector. The viral vector may be an adeno-associated virus (AAV).

In one aspect, the disclosure relates to a host cell (e.g., a mammalian cell, e.g., a human cell) comprising the system described above.

In one aspect, the disclosure relates to a method of correcting a mutation in the human PAH gene in a cell, tissue or subject, the method comprising administering the system described above to the cell, tissue or subject, wherein optionally the correction of the mutant PAH gene comprises an amino acid substitution of W408R, Q261R, and/or Q243R (reversing the pathogenic substitution which is R408W, R261Q, or R243Q). In another aspect, the correction of the mutant PAH gene comprises a nucleic acid substitution of IVS10-11A>G (reversing the pathogenic substitution which is IVS10-11G>A). The system may be introduced in vivo, in vitro, ex vivo, or in situ. The nucleic acid of (a) may be integrated into the genome of the host cell. In some embodiments, the nucleic acid of (a) is not integrated into the genome of the host cell. In some embodiments, the heterologous object sequence is inserted at only one target site in the host cell genome. The heterologous object sequence may be inserted at two or more target sites in the host cell genome, e.g., at the same corresponding site in two homologous chromosomes or at two different sites on the same or different chromosomes. The heterologous object sequence may encode a mammalian polypeptide, or a fragment or a variant thereof. The components of the system may be delivered on 1, 2, 3, 4, or more distinct nucleic acid molecules. The system may be introduced into a host cell by electroporation or by using at least one vehicle selected from a plasmid vector, a viral vector, a vesicle, and a lipid nanoparticle.

Features of the compositions or methods can include one or more of the following enumerated embodiments.

Enumerated Embodiments

1. A template RNA comprising, e.g., from 5' to 3':
   - (i) a gRNA spacer that is complementary to a first portion of the human PAH gene, wherein the gRNA spacer has a sequence comprising the core nucleotides of a gRNA spacer sequence of Table 1A, Table 1B, Table 1C, or Table 1D, or a sequence having 1, 2, or 3 substitutions thereto, and optionally comprises one or more consecutive nucleotides starting with the 3' end of the flanking nucleotides of the gRNA spacer (e.g., comprises one or more flanking nucleotides that are adjacent to the core nucleotides), or wherein the gRNA spacer has a sequence of a spacer chosen from Tables 5A-5F, 8A-8D, E3, E3A, BB, E5, ESA, E6, or E6A;
   - (ii) a gRNA scaffold that binds a gene modifying polypeptide (e.g., binds the Cas domain of the gene modifying polypeptide),
   - (iii) a heterologous object sequence comprising a mutation region to introduce a mutation into (e.g., to correct a mutation in) a second portion of the human PAH gene (wherein optionally the heterologous object sequence comprises, from 5' to 3', a post-edit homology region, a mutation region, and a pre-edit homology region), and
(iv) a primer binding site (PBS) sequence comprising at least 3, 4, 5, 6, 7, or 8 bases with 100% identity to a third portion of the human PAH gene.

2. The template RNA of embodiment 1, wherein the heterologous object sequence comprises the core nucleotides of an RT template sequence from Table 3A, Table 3B, Table 3C, or Table 3D, or a sequence having 1, 2, or 3 substitutions thereto, and optionally comprises one or more consecutive nucleotides starting with the 3' end of the flanking nucleotides of the RT template sequence, or wherein the heterologous object sequence comprises a sequence of an RT template sequence from Tables 5A-5F, 8A-8D, E3, E3A, BB, E5, ESA, E6, or E6A.
3. The template RNA of embodiment 1, wherein the heterologous object sequence comprises the core nucleotides of the RT template sequence of Table 3A, Table 3B, Table 3C, or Table 3D that corresponds to the gRNA spacer sequence, or a sequence having 1, 2, or 3 substitutions thereto, and optionally comprises one or more consecutive nucleotides starting with the 3' end of the flanking nucleotides of the RT template sequence (e.g., comprises one or more flanking nucleotides that are adjacent to the core nucleotides), or wherein the heterologous object sequence comprises a sequence of an RT template sequence from Tables 5A-5F, 8A-8D, E3, E3A, BB, E5, E5A, E6, or E6A.
4. The template RNA according to any one of embodiments 1-3 wherein the PBS sequence has a sequence comprising the core nucleotides of the PBS sequence from the same row of Table 3A, Table 3B, Table 3C, or Table 3D as the RT template sequence, or a sequence having 1, 2, or 3 substitutions thereto, and optionally comprises one or more consecutive nucleotides starting with the 5' end of the flanking nucleotides of the PBS sequence (e.g., comprises one or more flanking nucleotides that are adjacent to the core nucleotides).
5. The template RNA according to any one of embodiments 1-3, wherein the PBS sequence has a sequence comprising the core nucleotides of a PBS sequence of Table 3A, Table 3B, Table 3C, or Table 3D that corresponds to the RT template sequence, or a sequence having 1, 2, or 3 substitutions thereto, the gRNA spacer sequence, or both, and optionally comprises one or more consecutive nucleotides starting with the 5' end of the flanking nucleotides of the PBS sequence, or wherein the PBS sequence comprises a PBS sequence from Tables 5A-5F, 8A-8D, E3, E3A, BB, E5, ESA, E6, or E6A that corresponds to the RT template sequence, or a sequence having 1, 2, or 3 substitutions thereto, the gRNA spacer sequence, or both.
6. The template RNA according to any of embodiments 1-5, wherein the gRNA scaffold comprises a sequence of a gRNA scaffold of Table 12, or a sequence having at least 70%, 75%, 80%, 85%, 90%, 95%, 96%, 97%, 98%, or 99% identity thereto.
7. The template RNA according to any of embodiments 1-5, wherein the gRNA scaffold comprises a sequence of a gRNA scaffold of Table 12 that corresponds to the RT template sequence, the gRNA spacer sequence, or both, or a sequence having at least 70%, 75%, 80%, 85%, 90%, 95%, 96%, 97%, 98%, or 99% identity thereto.
8. A template RNA comprising, e.g., from 5' to 3':
(i) a gRNA spacer that is complementary to a first portion of the human PAH gene,
(ii) a gRNA scaffold that binds a gene modifying polypeptide (e.g., binds the Cas domain of the gene modifying polypeptide),
(iii) a heterologous object sequence comprising a mutation region to introduce a mutation into a second portion of the human PAH gene, wherein the heterologous object sequence comprises the core nucleotides of an RT template sequence of Table 3A, Table 3B, Table 3C, or Table 3D, or a sequence having 1, 2, or 3 substitutions thereto, and optionally comprises one or more consecutive nucleotides starting with the 3' end of the flanking nucleotides of the RT template sequence, or wherein the heterologous object sequence comprises an RT template sequence of Tables 5A-5F, 8A-8D, E3, E3A, BB, E5, ESA, E6, or E6A; and
(iv) a PBS sequence comprising at least 3, 4, 5, 6, 7, or 8 bases of 100% identity to a third portion of the human PAH gene.
9. The template RNA of embodiment 8, wherein the gRNA spacer comprises the core nucleotides of a gRNA spacer sequence of Table 1A, Table 1B, Table 1C, or Table 1D, or a sequence having 1, 2, or 3 substitutions thereto, and optionally comprises one or more consecutive nucleotides starting with the 3' end of the flanking nucleotides of the gRNA spacer sequence, or wherein the gRNA spacer comprises a gRNA spacer sequence of Tables 5A-5F, 8A-8D, E3, E3A, BB, E5, ESA, E6, or E6A.
10. The template RNA of any one of embodiments 1-9, wherein the gRNA spacer comprises ACCTCAATCCTTTGGGTGTA (SEQ ID NO: 16355), or a sequence having 1, 2, or 3 substitutions thereto.
11. The template RNA of any one of embodiments 1-9, wherein the gRNA spacer comprises CCTCAATCCTTTGGGTGTAT (SEQ ID NO: 16332), or a sequence having 1, 2, or 3 substitutions thereto.
12. The template RNA of any one of embodiments 1-9, wherein the gRNA spacer comprises TGGGTCGTAGCGAACTGAGA (SEQ ID NO: 16102), or a sequence having 1, 2, or 3 substitutions thereto.
13. The template RNA of any one of embodiments 1-9, wherein the gRNA spacer comprises GGGTCGTAGCGAACTGAGAA (SEQ ID NO: 16084), or a sequence having 1, 2, or 3 substitutions thereto.
14. The template RNA of any one of embodiments 1-9, wherein the gRNA spacer comprises TAGCGAACTGAGAAGGGCCA (SEQ ID NO: 16011), or a sequence having 1, 2, or 3 substitutions thereto.
15. The template RNA of any one of embodiments 1-9, wherein the gRNA spacer comprises ACTTTGCTGCCACAATACCT (SEQ ID NO: 16032), or a sequence having 1, 2, or 3 substitutions thereto.
16. The template RNA of embodiment 8, wherein the heterologous object sequence comprises the core nucleotides of the gRNA spacer sequence of Table 1A, Table 1B, Table 1C, or Table 1D that corresponds to the RT template sequence, or a sequence having 1, 2, or 3 substitutions thereto, and optionally comprises one or more consecutive nucleotides starting with the 3' end of the flanking nucleotides of the gRNA spacer sequence, or wherein the heterologous object sequence comprises the nucleotides of the gRNA spacer sequence of Tables 5A-5F, 8A-8D, E3, E3A, BB, E5, ESA, E6, or E6A that corresponds to the RT template sequence, or a sequence having 1, 2, or 3 substitutions thereto.

17. The template RNA according to any one of embodiments 8-16, wherein the PBS sequence has a sequence comprising the core nucleotides of the PBS sequence from the same row of Table 3A, Table 3B, Table 3C, or Table 3D as the RT template sequence, or a sequence having 1, 2, or 3 substitutions thereto, and optionally comprises one or more consecutive nucleotides starting with the 5' end of the flanking nucleotides of the PBS sequence.
18. The template RNA according to any one of embodiments 8-16, wherein the PBS sequence has a sequence comprising the core nucleotides of a PBS sequence of Table 3A, Table 3B, Table 3C, or Table 3D that corresponds to the RT template sequence, or a sequence having 1, 2, or 3 substitutions thereto, the gRNA spacer sequence, or both, and optionally comprises one or more consecutive nucleotides starting with the 5' end of the flanking nucleotides of the PBS sequence, or wherein the PBS sequence has a sequence comprising the a PBS sequence of Tables 5A-5F, 8A-8D, E3, E3A, BB, E5, ESA, E6, or E6A that corresponds to the RT template sequence, the gRNA spacer sequence, or both.
19. The template RNA according to any of embodiments 8-18, wherein the gRNA scaffold comprises a sequence of a gRNA scaffold of Table 12, or a sequence having at least 70%, 75%, 80%, 85%, 90%, 95%, 96%, 97%, 98%, or 99% identity thereto.
20. The template RNA according to any of embodiments 8-18, wherein the gRNA scaffold comprises a sequence of a gRNA scaffold of Table 12 that corresponds to the RT template sequence, the gRNA spacer sequence, or both, or a sequence having at least 70%, 75%, 80%, 85%, 90%, 95%, 96%, 97%, 98%, or 99% identity thereto.
21. A gene modifying system for modifying DNA, comprising:
    (a) a first RNA comprising, from 5' to 3, (i) a guide RNA sequence that is complementary to a first portion of the human PAH gene, wherein the guide RNA sequence has a sequence comprising the core nucleotides of a spacer sequence of Table 1A, Table 1B, Table 1C, or Table 1D, or a sequence having 1, 2, or 3 substitutions thereto, and optionally comprises one or more consecutive nucleotides starting with the 3' end of the flanking nucleotides of the guide RNA sequence, or wherein the guide RNA sequence has a sequence of a spacer chosen from Tables 5A-5F, 8A-8D, E3, E3A, BB, E5, ESA, E6, or E6A; and (ii) a sequence (e.g., a scaffold region) that binds a gene modifying polypeptide (e.g., binds the Cas domain of the gene modifying polypeptide), and
    (b) a second RNA comprising (iii) a heterologous object sequence comprising a nucleotide substitution to introduce a mutation into a second portion of the human PAH gene (wherein optionally the heterologous object sequence comprises, from 5' to 3', a post-edit homology region, a mutation region, and a pre-edit homology region), (iv) a primer region comprising at least 5, 6, 7, or 8 bases of 100% identity to a third portion of the human PAH gene, and (v) an RRS (RNA binding protein recognition sequence) that binds a gene modifying protein.
22. The gene modifying system of embodiment 21, wherein the heterologous object sequence comprises the core nucleotides of an RT template sequence from Table 3A, Table 3B, Table 3C, or Table 3D, or a sequence having 1, 2, or 3 substitutions thereto, and optionally comprises one or more consecutive nucleotides starting with the 3' end of the flanking nucleotides of the RT template sequence, or wherein the heterologous object sequence comprises a sequence of an RT template sequence from Tables 5A-5F, 8A-8D, E3, E3A, BB, E5, ESA, E6, or E6A, or a sequence having 1, 2, or 3 substitutions thereto.
23. The gene modifying system of embodiment 21, wherein the heterologous object sequence comprises the core nucleotides of the RT template sequence of Table 3A, Table 3B, Table 3C, or Table 3D that corresponds to the gRNA spacer sequence, or a sequence having 1, 2, or 3 substitutions thereto, and optionally comprises one or more consecutive nucleotides starting with the 3' end of the flanking nucleotides of the RT template sequence, or wherein the heterologous object sequence comprises a sequence of an RT template sequence from Tables 5A-5F, 8A-8D, E3, E3A, BB, E5, ESA, E6, or E6A that corresponds to the gRNA spacer sequence, or a sequence having 1, 2, or 3 substitutions thereto.
24. The gene modifying system of any one of embodiments 21-23, wherein the PBS sequence has a sequence comprising the core nucleotides of the PBS sequence from the same row of Table 3A, Table 3B, Table 3C, or Table 3D as the RT template sequence, or a sequence having 1, 2, or 3 substitutions thereto, and optionally comprises one or more consecutive nucleotides starting with the 5' end of the flanking nucleotides of the PBS sequence, or wherein the PBS sequence has a sequence of a PBS sequence from Tables 5A-5F, 8A-8D, E3, E3A, BB, E5, E5A, E6, or E6A, or a sequence having 1, 2, or 3 substitutions thereto.
25. The gene modifying system of one of embodiments 21-23, wherein the PBS sequence has a sequence comprising the core nucleotides of a PBS sequence of Table 3A, Table 3B, Table 3C, or Table 3D that corresponds to the RT template sequence, or a sequence having 1, 2, or 3 substitutions thereto, the gRNA spacer sequence, or both, and optionally comprises one or more consecutive nucleotides starting with the 5' end of the flanking nucleotides of the PBS sequence, or wherein the PBS sequence has a sequence of a PBS sequence from Tables 5A-5F, 8A-8D, E3, E3A, BB, E5, ESA, E6, or E6A that corresponds to the RT template sequence, or a sequence having 1, 2, or 3 substitutions thereto.
26. The gene modifying system of any one of embodiments 21-25, wherein the gRNA scaffold comprises a sequence of a gRNA scaffold of Table 12, or a sequence having at least 70%, 75%, 80%, 85%, 90%, 95%, 96%, 97%, 98%, or 99% identity thereto.
27. The gene modifying system of any one of embodiments 21-25, wherein the gRNA scaffold comprises a sequence of a gRNA scaffold of Table 12 that corresponds to the RT template sequence, the gRNA spacer sequence, or both, or a sequence having at least 70%, 75%, 80%, 85%, 90%, 95%, 96%, 97%, 98%, or 99% identity thereto.
28. A gene modifying system for modifying DNA, comprising:

(a) a first RNA comprising, from 5' to 3, (i) a guide RNA sequence that is complementary to a first portion of the human PAH gene, and (ii) a sequence (e.g., a scaffold region) that binds a gene modifying polypeptide (e.g., binds the Cas domain of the gene modifying polypeptide), and (b) a second RNA comprising (iii) a heterologous object sequence comprising a nucleotide substitution to introduce a mutation into a second portion of the human PAH gene, wherein the heterologous object sequence comprises the core nucleotides of an RT template sequence of Table 3A, Table 3B, Table 3C, or Table 3D, or a sequence having 1, 2, or 3 substitutions thereto, and optionally comprises one or more consecutive nucleotides starting with the 3' end of the flanking nucleotides of the RT template sequence, or wherein the heterologous object sequence comprises an RT sequence from Tables 5A-5F, 8A-8D, E3, E3A, BB, E5, E5A, E6, or E6A, or a sequence having 1, 2, or 3 substitutions thereto, and (iv) a primer region comprising at least 5, 6, 7, or 8 bases of 100% homology to a third portion of the human PAH gene, and (v) an RRS (RNA binding protein recognition sequence) that binds a gene modifying protein.

29. The gene modifying system of embodiment 28, wherein the gRNA spacer comprises the core nucleotides of a gRNA spacer sequence of Table 1A, Table 1B, Table 1C, or Table 1D, or a sequence having 1, 2, or 3 substitutions thereto, and optionally comprises one or more consecutive nucleotides starting with the 3' end of the flanking nucleotides of the gRNA spacer sequence, or wherein the gRNA spacer comprises a gRNA spacer sequence from Tables 5A-5F, 8A-8D, E3, E3A, BB, E5, ESA, E6, or E6A, or a sequence having 1, 2, or 3 substitutions thereto.

30. The gene modifying system of embodiment 28, wherein the heterologous object sequence comprises the core nucleotides of the gRNA spacer sequence of Table 1A, Table 1B, Table 1C, or Table 1D that corresponds to the RT template sequence, or a sequence having 1, 2, or 3 substitutions thereto, and optionally comprises one or more consecutive nucleotides starting with the 3' end of the flanking nucleotides of the gRNA spacer sequence, or wherein the heterologous object sequence comprises a gRNA spacer sequence from Tables 5A-5F, 8A-8D, E3, E3A, BB, E5, ESA, E6, or E6A that corresponds to the RT template sequence, or a sequence having 1, 2, or 3 substitutions thereto.

31. The gene modifying system of any one of embodiments 28-30, wherein the PBS sequence has a sequence comprising the core nucleotides of the PBS sequence from the same row of Table 3A, Table 3B, Table 3C, or Table 3D as the RT template sequence, or a sequence having 1, 2, or 3 substitutions thereto, and optionally comprises one or more consecutive nucleotides starting with the 5' end of the flanking nucleotides of the PBS sequence, or wherein the PBS sequence has a sequence comprising a PBS sequence from Tables 5A-5F, 8A-8D, E3, E3A, BB, E5, ESA, E6, or E6A, or a sequence having 1, 2, or 3 substitutions thereto.

32. The gene modifying system of any one of embodiments 28-30, wherein the PBS sequence has a sequence comprising the core nucleotides of a PBS sequence of Table 3A, Table 3B, Table 3C, or Table 3D that corresponds to the RT template sequence, the gRNA spacer sequence, or both, or a sequence having 1, 2, or 3 substitutions thereto, and optionally comprises one or more consecutive nucleotides starting with the 5' end of the flanking nucleotides of the PBS sequence, or wherein the PBS sequence has a sequence comprising a PBS sequence from Tables 5A-5F, 8A-8D, E3, E3A, BB, E5, E5A, E6, or E6A that corresponds to the RT template sequence, the gRNA spacer sequence, or both, or a sequence having 1, 2, or 3 substitutions thereto.

33. The gene modifying system of any one of embodiments 28-32, wherein the gRNA scaffold comprises a sequence of a gRNA scaffold of Table 12, or a sequence having at least 70%, 75%, 80%, 85%, 90%, 95%, 96%, 97%, 98%, or 99% identity thereto.

34. The gene modifying system of any one of embodiments 28-32, wherein the gRNA scaffold comprises a sequence of a gRNA scaffold of Table 12 that corresponds to the RT template sequence, the gRNA spacer sequence, or both, or a sequence having at least 70%, 75%, 80%, 85%, 90%, 95%, 96%, 97%, 98%, or 99% identity thereto.

35. A gRNA comprising (i) a gRNA spacer sequence that is complementary to a first portion of the human PAH gene, wherein the gRNA spacer has a sequence comprising the core nucleotides of a gRNA spacer sequence of Table 1A, Table 1B, Table 1C, or Table 1D, Table 2A, Table 2B, Table 2C, or Table 2D, or Table 4A, Table 4B, Table 4C, or Table 4D, or a sequence having 1, 2, or 3 substitutions thereto and optionally comprises one or more consecutive nucleotides starting with the 3' end of the flanking nucleotides of the gRNA spacer sequence, or wherein the gRNA spacer has a sequence comprising a gRNA spacer sequence from Tables 5A-5F, 8A-8D, E3, E3A, BB, E5, ESA, E6, or E6A or a sequence having 1, 2, or 3 substitutions thereto; and (ii) a gRNA scaffold.

36. The gRNA of embodiment 35, wherein the gRNA scaffold comprises a sequence of a gRNA scaffold of Table 12, or a sequence having at least 70%, 75%, 80%, 85%, 90%, 95%, 96%, 97%, 98%, or 99% identity thereto.

37. The gRNA of embodiment 35, wherein the gRNA scaffold comprises a sequence of a gRNA scaffold of Table 12 that corresponds to the gRNA spacer sequence, or a sequence having at least 70%, 75%, 80%, 85%, 90%, 95%, 96%, 97%, 98%, or 99% identity thereto.

38. A template RNA comprising: (iii) a heterologous object sequence comprising a mutation region to introduce a mutation into a second portion of the human PAH gene, wherein the heterologous object sequence comprises the core nucleotides of an RT template sequence of Table 3A, Table 3B, Table 3C, or Table 3D, or a sequence having 1, 2, or 3 substitutions thereto, and optionally comprises one or more consecutive nucleotides starting with the 3' end of the flanking nucleotides of the RT template sequence, or wherein the heterologous object sequence comprises an RT template sequence from Tables 5A-5F, 8A-8D, E3, E3A, BB, E5, ESA, E6, or E6A or a sequence having 1, 2, or 3 substitutions thereto, and (iv) a PBS sequence comprising at least 5, 6, 7, or 8 bases of 100% homology to a third portion of the human PAH gene.

39. The template RNA according to embodiment 38, wherein the PBS sequence has a sequence comprising the core nucleotides of the PBS sequence from the same row of Table 3A, Table 3B, Table 3C, or Table 3D as the RT template sequence, or a sequence having 1, 2, or 3 substitutions thereto, and optionally comprises one or more consecutive nucleotides starting with the 5' end of the flanking nucleotides of the PBS sequence.

40. The template RNA according to embodiment 38, wherein the PBS sequence has a sequence comprising the core nucleotides of a PBS sequence of Table 3A, Table 3B, Table 3C, or Table 3D that corresponds to the RT template sequence, or a sequence having 1, 2, or 3 substitutions thereto, and optionally comprises one or more consecutive nucleotides starting with the 5' end of the flanking nucleotides of the PBS sequence, or wherein the PBS sequence comprises a PBS sequence from Tables 5A-5F, 8A-8D, E3, E3A, BB, E5, ESA, E6, or E6A that corresponds to the RT template sequence, or a sequence having 1, 2, or 3 substitutions thereto.

41. The template RNA according to any one of embodiments 1-20 or 38-40, the gene modifying system of any one of embodiments 21-35, or the gRNA of any one of embodiments 35-37, wherein the mutation introduced by the system is a W408R, Q261R, Q243R, and/or IVS10-11A>G mutation (e.g., to correct a pathogenic R408W, R261Q, R243Q, and/or IVS10-11G>A mutation) of the PAH gene.

42. The template RNA according to any one of embodiments 1-20 or 38-41 or the gene modifying system of any one of embodiments 35-37 or 41, wherein the pre-edit sequence comprises between about 1 nucleotide to about 35 nucleotides (e.g., comprises about 1-5, 5-10, 10-15, 15-20, 20-25, 25-30, or 30-35 nucleotides) in length.

43. The template RNA according to any one of embodiments 1-20 or 38-42 or the gene modifying system of any one of embodiments 35-37, 41, or 42, wherein the mutation region comprises a single nucleotide.

44. The template RNA according to any one of embodiments 1-20 or 38-42 or the gene modifying system of any one of embodiments 35-37, 41, or 42, wherein the mutation region is at least two nucleotides in length.

45. The template RNA according to any one of embodiments 1-20, 38-42, or 44 or the gene modifying system of any one of embodiments 35-37, 41, 42, or 44, wherein the mutation region is up to 32 (e.g., up to 5, 10, 15, 20, 25, 30, or 32) nucleotides in length and comprises one, two, or three sequence differences relative to a second portion of the human PAH gene.

46. The template RNA according to any one of embodiments 1-20, 38-42, 44, or 45 or the gene modifying system of any one of embodiments 35-37, 41, 42, 44, or 45, wherein the mutation region comprises two sequences differences relative to a second portion of the human PAH gene.

47. The template RNA according to any one of embodiments 1-20, 38-42, or 44-46 or the gene modifying system of any one of embodiments 35-37, 41, 42, or 44-46, wherein the mutation region comprises a first region (e.g., a first nucleotide) designed to correct a pathogenic mutation in the PAH gene and a second region (e.g., a second nucleotide) designed to inactivate a PAM sequence (e.g., a "PAM-kill" mutation as described herein).

48. The template RNA according to any one of embodiments 1-20 or 38-46 or the gene modifying system of any one of embodiments 35-37 or 41-46, wherein the mutation region comprises less than 80%, 70%, 60%, 50%, 40%, or 30% identity to corresponding portion of the human PAH gene.

49. The template RNA of any one of the preceding embodiments, wherein the template RNA comprises one or more silent mutations (e.g., silent substitutions), e.g., as exemplified in Tables 7A-7C, 8A-8D, E6, or E6A.

50. The template RNA of any of the preceding embodiments, wherein the mutation region comprises a first region designed to correct a pathogenic mutation in the PAH gene and a second region designed to introduce a silent substitution.

51. The template RNA of any one of the preceding embodiments, which comprises one or more chemically modified nucleotides.

52. A gene modifying system comprising:

a template RNA of any of embodiments 1-20, 38-46, or a system of any of embodiments 35-37 or 41-46, and a gene modifying polypeptide, or a nucleic acid (e.g., RNA) encoding the gene modifying polypeptide.

53. The gene modifying system of embodiment 52, wherein the gene modifying polypeptide comprises:

a reverse transcriptase (RT) domain (e.g., an RT domain from a retrovirus, or a polypeptide domain having at least 75%, 80%, 85%, 90%, 95%, 96%, 97%, 98%, or 99% amino acids sequence identity thereto); and a Cas domain that binds to the target DNA molecule and is heterologous to the RT domain (e.g., a Cas9 domain); and optionally, a linker disposed between the RT domain and the Cas domain.

54. The gene modifying system of embodiment 53, wherein the RT domain comprises:

(a) an RT domain of Table 6; or (b) an RT domain from a murine leukemia virus (MMLV), a porcine endogenous retrovirus (PERV); Avian reticuloendotheliosis virus (AVIRE), a feline leukemia virus (FLV), simian foamy virus (SFV) (e.g., SFV3L), bovine leukemia virus (BLV), Mason-Pfizer monkey virus (MPMV), human foamy virus (HFV), or bovine foamy/syncytial virus (BFV/BSV).

55. The gene modifying system of embodiment 53 or 54, wherein the Cas domain comprises a Cas domain of Table 7 or Table 8.

56. The gene modifying system of any one of embodiments 53-55, wherein the Cas domain:

(a) is a Cas9 domain;

(b) is a SpCas9 domain, a BlatCas9 domain, a Nme2Cas9 domain, a PnpCas9 domain, a SauCas9 domain, a SauCas9-KKH domain, a SauriCas9 domain, a SauriCas9-KKH domain, a ScaCas9-Sc++ domain, a SpyCas9 domain, a SpyCas9-NG domain, a SpyCas9-SpRY domain, or a St1Cas9 domain; and/or (c) is a Cas9 domain comprising an N670A mutation, an N611A mutation, an N605A mutation, an N580A mutation, an N588A mutation, an N872A mutation, an N863 mutation, an N622A mutation, or an H840A mutation.

57. The gene modifying system of embodiment 56, wherein the Cas9 domain binds a PAM sequence listed in Table 7 or Table 12.

58. The gene modifying system of embodiment 57, wherein a second portion of the human PAH gene overlaps with a PAM recognized by the Cas domain, e.g., wherein the second portion of the human PAH gene is within the PAM or wherein the PAM is within the second portion of the human PAH gene).

59. The gene modifying system any one of embodiments 52-58, wherein the gRNA spacer is a gRNA spacer according to Table 1A, Table 1B, Table 1C, or Table 1D, and the Cas domain comprises a Cas domain listed in the same row of Table 1A, Table 1B, Table 1C, or Table 1D, or a sequence having at least 70%, 75%, 80%, 85%, 90%, 95%, 96%, 97%, 98%, or 99% identity thereto.

60. The gene modifying system of any one of embodiments 52-58, wherein the template RNA comprises a sequence of a template RNA sequence of Table 5A-5F, 8A-8D, E3, E3A, BB, E5, ESA, E6, or E6A or a sequence having at least 70%, 75%, 80%, 85%, 90%, 95%, 96%, 97%, 98%, or 99% identity thereto.

61. The gene modifying system of any one of embodiments 52-60, wherein:
   (a) the template RNA comprises a sequence of a template RNA sequence of Tables 3A-3D, 5A-5F, 8A-8D, E3, E3A, BB, E5, ESA, E6, or E6A;
   (b) the Cas domain comprises a Cas domain of Table 7 or Table 8;
   (c) the linker comprises a linker sequence of Table 10 (e.g., of any of SEQ ID NOs: 5217, 5106, 5190, and 5218); and
   (d) the gene modifying polypeptide comprises one or two NLS sequences from Table 11 (e.g., of any of SEQ ID NOs: 5245, 5290, 5323, 5330, 5349, 5350, 5351, and 4001).

62. The gene modifying system of any of embodiments 52-61, which produces a first nick in a first strand of the human PAH gene.

63. The gene modifying system of embodiment 62, which further comprises a second strand-targeting gRNA that directs a second nick to the second strand of the human PAH gene.

64. The gene modifying system of embodiment 63, wherein the second strand-targeting gRNA comprises:
   (i) a sequence comprising the core nucleotides of a left gRNA spacer sequence or a right gRNA spacer sequence from Table 2A, Table 2B, Table 2C, or Table 2D, and optionally comprises one or more consecutive nucleotides starting with the 3' end of the flanking nucleotides of the left gRNA spacer sequence or right gRNA spacer sequence; or
   (ii) a second-strand-targeting gRNA comprising a spacer sequence of Table 6A, or a spacer sequence having 1, 2, or 3 substitutions thereto.

65. The gene modifying system of embodiment 63, wherein the second strand-targeting gRNA comprises a sequence comprising the core nucleotides of a left gRNA spacer sequence or a right gRNA spacer sequence from Table 2A, Table 2B, Table 2C, or Table 2D that corresponds to the gRNA spacer sequence of (i), and optionally comprises one or more consecutive nucleotides starting with the 3' end of the flanking nucleotides of the left gRNA spacer sequence or right gRNA spacer sequence.

66. The gene modifying system of embodiment 63, wherein the second strand-targeting gRNA comprises:
   (i) a sequence comprising the core nucleotides of a second nick gRNA sequence from Table 4A, Table 4B, Table 4C, Table 4D, or a sequence having at least 70%, 75%, 80%, 85%, 90%, 95%, 96%, 97%, 98%, or 99% identity thereto, and optionally comprises one or more consecutive nucleotides starting with the 3' end of the flanking nucleotides of the second nick gRNA sequence; or
   (ii) a second-strand-targeting gRNA comprising a spacer sequence from Table 6A or a sequence having at least 70%, 75%, 80%, 85%, 90%, 95%, 96%, 97%, 98%, or 99% identity thereto.

67. The gene modifying system of embodiment 63, wherein the second strand-targeting gRNA comprises a sequence comprising the core nucleotides of the second nick gRNA sequence from Table 4A, Table 4B, Table 4C, or Table 4D that corresponds to the gRNA spacer sequence of (i), or a sequence having at least 70%, 75%, 80%, 85%, 90%, 95%, 96%, 97%, 98%, or 99% identity thereto, and optionally comprises one or more consecutive nucleotides starting with the 3' end of the flanking nucleotides of the second nick gRNA sequence.

68. The gene modifying system of any one of embodiments 52-67, wherein the second strand-targeting gRNA has a "PAM-in orientation" with the template RNA of the gene modifying system, e.g., as exemplified in Tables 2A-2D, 4A-4D, or 6A.

69. The gene modifying system of any one of embodiments 52-68, the second strand-targeting gRNA targets a sequence overlapping the target mutation of the template RNA.

70. The gene modifying system of embodiment 69, wherein second strand-targeting gRNA comprises:
   (i) a sequence (e.g., a spacer sequence) complementary to the PAH mutation;
   (ii) a sequence (e.g., a spacer sequence) complementary to the wild-type sequence at the target locus;
   (iii) a sequence (e.g., a spacer sequence) complementary to a SNP proximal to the target locus, e.g., a SNP contained in the genomic DNA of a subject (e.g., a patient);
   (iv) a sequence (e.g., spacer sequence) complementary to or comprising one or more silent substitutions proximal to the target locus.

71. The template RNA, gene modifying system, or gRNA, of any one of the preceding embodiments, wherein the gRNA spacer comprises about 1, 2, 3, or more flanking nucleotides of the gRNA spacer.

72. The template RNA or gene modifying system of any one of the preceding embodiments, wherein the heterologous object sequence comprises about 2, 3, 4, 5, 10, 20, 30, 40, or more flanking nucleotides of the RT template sequence.

73. The template RNA or gene modifying system, of any one of the preceding embodiments, wherein the heterologous object sequence comprises between about 8-30, 9-25, 10-20, 11-16, or 12-15 (e.g., about 11-16) nucleotides.

74. The template RNA or gene modifying system, of any one of the preceding embodiments, wherein the mutation region comprises 1, 2, or 3 nucleotide positions of sequence differences relative to the corresponding portion of the human PAH gene.

75. The template RNA or gene modifying system of any one of the preceding embodiments, wherein the mutation region comprises at least 2 nucleotide positions of sequence difference relative to the corresponding portion of the human PAH gene.

76. The template RNA or gene modifying system, of any one of the preceding embodiments, wherein the post-edit homology region and/or pre-edit homology region comprises 100% identity to the PAH gene.

77. The template RNA or gene modifying system of any one of the preceding embodiments, wherein the PBS sequence additionally comprises about 1, 2, 3, 4, 5, 6, 7, or more flanking nucleotides.

78. The template RNA or gene modifying system of any one of the preceding embodiments, wherein the PBS sequence comprises about 5-20, 8-16, 8-14, 8-13, 9-13, 9-12, or 10-12 (e.g., about 9-12) nucleotides.

79. The template RNA or gene modifying system of any one of the preceding embodiments, wherein the PBS sequence binds within 1, 2, 3, 4, 5, 6, 7, 8, 9, or 10 nucleotides of a nick site in the PAH gene.

80. The gene modifying system of any one of the preceding embodiments, wherein the domains of the gene modifying polypeptide are joined by a peptide linker.

81. The gene modifying system of embodiment 80, wherein the linker comprises a sequence of a linker of Table 10 (e.g., of any of SEQ ID NOs: 5217, 5106, 5190, and 5218).

82. The gene modifying system of any one of the preceding embodiments, wherein the gene modifying polypeptide further comprise one or more nuclear localization sequences (NLS).

83. The gene modifying system of embodiment 82, wherein the gene modifying polypeptide comprises a first NLS and a second NLS.

84. The gene modifying system of embodiment 82 or 83, wherein the NLS comprises a sequence of a NLS of Table 11 (e.g., of any of SEQ ID NOs: 5245, 5290, 5323, 5330, 5349, 5350, 5351, and 4001).

85. A template RNA comprising a sequence of a template RNA of Table 4A-4D, 5A-5F, 8A-8D, E3, E3A, BB, E5, E5A, E6, or E6A, or a sequence having at least 70%, 75%, 80%, 85%, 90%, 95%, 96%, 97%, 98%, or 99% identity thereto.

86. A template RNA comprising a sequence of a template RNA of Tables 4A-4D, 5A-5F, 8A-8D, E3, E3A, BB, E5, E5A, E6, or E6A.

87. A gene modifying system comprising:
   (i) a template RNA comprising a sequence of a template RNA of Table 4A, Table 4B, Table 4C, or Table 4D, or a sequence having at least 70%, 75%, 80%, 85%, 90%, 95%, 96%, 97%, 98%, or 99% identity thereto; and
   (ii) a second-nick gRNA sequence from the same row of Table 4A, Table 4B, Table 4C, or Table 4D as (i), a sequence having at least 70%, 75%, 80%, 85%, 90%, 95%, 96%, 97%, 98%, or 99% identity thereto.

88. A gene modifying system comprising:
   (i) a template RNA comprising a sequence of a template RNA of Table 4A, Table 4B, Table 4C, or Table 4D; and
   (ii) a second-nick gRNA sequence from the same row of Table 4A, Table 4B, Table 4C, or Table 4D as (i).

89. A DNA encoding the template RNA of any one of embodiments 1-20, 38-48, 71-79, 85, or 86, or the gRNA of any one of embodiments 34-37.

90. A pharmaceutical composition, comprising the system of any one of embodiments 49-84, 87, or 88, or one or more nucleic acids encoding the same, and a pharmaceutically acceptable excipient or carrier.

91. The pharmaceutical composition of embodiment 90, wherein the pharmaceutically acceptable excipient or carrier is selected from the group consisting of a plasmid vector, a viral vector, a vesicle, and a lipid nanoparticle.

92. The pharmaceutical composition of embodiment 91, wherein the viral vector is an adeno-associated virus.

93. A host cell (e.g., a mammalian cell, e.g., a human cell) comprising the template RNA or gene modifying system of any one of the preceding embodiments.

94. A method of making the template RNA of any one of embodiments 1-20, 38-48, 71-79, 85, or 86, the method comprising synthesizing the template RNA by in vitro transcription (e.g., solid state synthesis) or by introducing a DNA encoding the template RNA into a host cell under conditions that allow for production of the template RNA.

95. A method for modifying a target site in the human PAH gene in a cell, the method comprising contacting the cell with the gene modifying system of any one of embodiments 49-84, 87, or 88, or DNA encoding the same, thereby modifying the target site in the human PAH gene in a cell.

96. A method for modifying a target site in the human PAH gene in a cell, the method comprising contacting the cell with: (i) the template RNA of any one of embodiments 49-84, 87, or 88, or DNA encoding the same; and (ii) a gene modifying polypeptide or a nucleic acid encoding a gene modifying polypeptide, thereby modifying the target site in the human PAH gene in a cell.

97. A method for treating a subject having a disease or condition associated with a mutation in the human PAH gene, the method comprising administering to the subject the gene modifying system of any one of embodiments 49-84, 87, or 88, or DNA encoding the same, thereby treating the subject having a disease or condition associated with a mutation in the human PAH gene.

98. A method for treating a subject having a disease or condition associated with a mutation in the human PAH gene, the method comprising administering to the subject the template RNA of any one of embodiments 49-84, 87, or 88, or DNA encoding the same; and (ii) a gene modifying polypeptide or a nucleic acid encoding a gene modifying polypeptide, thereby treating the subject having a disease or condition associated with a mutation in the human PAH gene.

99. The method of embodiment 97 or 98, wherein the disease or condition is phenylketonuria (PKU).

100. The method of any one of embodiments 97-99, wherein the subject has a R408W, R261Q, R243Q, and/or IVS10-11G>A mutation.

101. A method for treating a subject having PKU the method comprising administering to the subject the gene modifying system of any one of embodiments 49-84, 87, or 88, or DNA encoding the same, thereby treating the subject having PKU.

102. A method for treating a subject having PKU the method comprising administering to the subject (i) the template RNA of any one of embodiments 49-84, 87, or 88, or DNA encoding the same, and (ii) a gene modifying polypeptide or a nucleic acid encoding a gene modifying polypeptide, thereby treating the subject having PKU.

103. The gene modifying system or method of any one of the preceding embodiments, wherein introduction of the system into a target cell results in a correction of a pathogenic mutation in the PAH gene.

104. The gene modifying system or method of any one of the preceding embodiments, wherein the pathogenic mutation is a W408R, Q261R, Q243R, and/or IVS10-11A>G mutation, and wherein the correction comprises an amino acid substitution of R408W, R261Q, or R243Q, or a nucleic acid substitution of IVS10-11G>A.
105. The gene modifying system or method of any of the preceding embodiments, wherein correction of the mutation occurs in at least 30% (e.g., 30%, 40%, 50%, 60%, 70%, or more) of target nucleic acids.
106. The gene modifying system or method of any of the preceding embodiments, wherein correction of the mutation occurs in at least 30% (e.g., 30%, 40%, 50%, 60%, 70%, or more) of target cells.
107. The gene modifying system or method of any of the preceding embodiments, wherein the gene modifying system comprises a second strand-targeting gRNA, and wherein correction of the mutation in a population of target cells is increased relative to a population of target cells treated with a gene modifying system comprising a template RNA without a second strand-targeting gRNA.
108. The gene modifying system or method of any of the preceding embodiments, wherein the template RNA comprises one or more silent substitutions (e.g., as exemplified in Tables 7A, X4, and X4A), and wherein correction of the mutation in a population of target cells is increased relative to a population of target cells treated with a gene modifying system comprising a template RNA that does not comprise one or more silent substitutions.
109. The method of any of the preceding embodiments, wherein the cell is a mammalian cell, such as a human cell.
110. The method of any one of the preceding embodiments, wherein the subject is a human.
111. The method of any of the preceding embodiments, wherein the contacting occurs ex vivo, e.g., wherein the cell's or subject's DNA is modified ex vivo.
112. The method of any of the preceding embodiments, wherein the contacting occurs in vivo, e.g., wherein the cell's or subject's DNA is modified in vivo.
113. The method of any of the preceding embodiments, wherein contacting the cell or the subject with the system comprises contacting the cell or a cell within the subject with a nucleic acid (e.g., DNA or RNA) encoding the gene modifying polypeptide under conditions that allow for production of the gene modifying polypeptide.

Additional Enumerated Embodiments

A1. A template RNA comprising, from 5' to 3':
(i) a gRNA spacer that is complementary to a first portion of the human PAH gene, wherein the gRNA spacer has a nucleotide sequence comprising ACCTCAATCCTTTGGGTGTA (SEQ ID NO: 16355), or a nucleotide sequence having 1, 2, or 3 substitution thereto;
(ii) a gRNA scaffold that binds a Cas domain of a gene modifying polypeptide,
(iii) a heterologous object sequence comprising a mutation region to correct a mutation in a second portion of the human PAH gene, and
(iv) a primer binding site (PBS) sequence comprising at least 5 bases with 100% identity to a third portion of the human PAH gene.
A2. The template RNA of embodiment A1, wherein the gRNA spacer has a nucleotide sequence comprising ACCTCAATCCTTTGGGTGTA (SEQ ID NO: 16355).
A3. The template RNA of any of the preceding embodiments, wherein the heterologous object sequence comprises a sequence of at least 30 nucleotides from the 3' end of a sequence according to tcactcaagcctgtggtifiggtcttaggaactttgctgccacaatacctCggcccttctcagttcgctacgacccatac (SEQ ID NO: 24984), or a sequence having 1, 2, 3, or 4 substitutions thereto.
A4. The template RNA of any of the preceding embodiments, wherein the heterologous object sequence comprises a sequence of tcactcaagcctgtggtifiggtcttaggaactttgctgccacaatacctCggcccttctcagttcgctacgacccatac (SEQ ID NO: 24984), or comprises at least 40, 50, 60, or 70 nucleotides from the 3' end of said sequence, or a sequence having 1, 2, 3, or 4 substitutions thereto.
A5. The template RNA of any of the preceding embodiments, wherein the heterologous object sequence comprises a sequence of at least 30 nucleotides from the 3' end of a sequence according to tcactcaagcctgtggtifiggtcttaggaactttgctgccacaatacctCggcccttctcagttcgctacgacccatac (SEQ ID NO: 24984).
A6. The template RNA of any of the preceding embodiments, wherein the heterologous object sequence comprises a sequence of tcactcaagcctgtggtifiggtcttaggaactttgctgccacaatacctCggcccttctcagttcgctacgacccatac (SEQ ID NO: 24984), or comprises at least 40, 50, 60, or 70 nucleotides from the 3' end of said sequence.
A7. The template RNA of any of the preceding embodiments, wherein the PBS comprises a sequence of at least 5, 6, 7, or 8 nucleotides from the 5' end of a sequence according to acccaaagg, or a sequence having 1 substitution thereto.
A8. The template RNA of any of the preceding embodiments, wherein the PBS comprises a sequence of acccaaagg
A9. A template RNA comprising, from 5' to 3':
(i) a gRNA spacer that is complementary to a first portion of the human PAH gene, wherein the gRNA spacer has a nucleotide sequence comprising CCTCAATCCTTTGGGTGTAT (SEQ ID NO: 16332), or a nucleotide sequence having 1, 2, or 3 substitution thereto;
(ii) a gRNA scaffold that binds a Cas domain of a gene modifying polypeptide,
(iii) a heterologous object sequence comprising a mutation region to correct a mutation in a second portion of the human PAH gene, and
(iv) a primer binding site (PBS) sequence comprising at least 5 bases with 100% identity to a third portion of the human PAH gene.
A10. The template RNA of embodiment A9, wherein the gRNA spacer has a nucleotide sequence comprising CCTCAATCCTTTGGGTGTAT (SEQ ID NO: 16332).
A11. The template RNA of any of the preceding embodiments, wherein the heterologous object sequence comprises a sequence of at least 50 nucleotides from the 3' end of a sequence according to tcactcaagcctgtggtifiggtcttaggaactttgctgccacaatacctCggcccttctcagttcgctacgacccata (SEQ ID NO: 24975), or a sequence having 1, 2, 3, or 4 substitutions thereto.

A12. The template RNA of any of the preceding embodiments, wherein the heterologous object sequence comprises a sequence of tcactcaagcctgtggtifiggtcttaggaactttgctgccacaatacctCggcccttctcagttcgctacgacccata (SEQ ID NO: 24975), or comprises at least 60 or 70 nucleotides from the 3' end of said sequence, or a sequence having 1, 2, 3, or 4 substitutions thereto.

A13. The template RNA of any of the preceding embodiments, wherein the heterologous object sequence comprises a sequence of at least 50 nucleotides from the 3' end of a sequence according to tcactcaagcctgtggtifiggtcttaggaactttgctgccacaatacctCggcccttctcagttcgctacgacccata (SEQ ID NO: 24975).

A14. The template RNA of any of the preceding embodiments, wherein the heterologous object sequence comprises a sequence of tcactcaagcctgtggtifiggtcttaggaactttgctgccacaatacctCggcccttctcagttcgctacgacccata (SEQ ID NO: 24975), or comprises at least 60 or 70 nucleotides from the 3' end of said sequence.

A15. The template RNA of any of the preceding embodiments, wherein the PBS comprises a sequence of at least 5, 6, 7, or 8 nucleotides from the 5' end of a sequence according to cacccaaag, or a sequence having 1 substitution thereto.

A16. The template RNA of any of the preceding embodiments, wherein the PBS comprises a sequence of cacccaaag.

A17. A template RNA comprising, from 5' to 3':

(i) a gRNA spacer that is complementary to a first portion of the human PAH gene, wherein the gRNA spacer has a nucleotide sequence comprising TGGGTCGTAGCGAACTGAGA (SEQ ID NO: 16102), or a nucleotide sequence having 1, 2, or 3 substitution thereto;

(ii) a gRNA scaffold that binds a Cas domain of a gene modifying polypeptide, (iii) a heterologous object sequence comprising a mutation region to correct a mutation in a second portion of the human PAH gene, and (iv) a primer binding site (PBS) sequence comprising at least 5 bases with 100% identity to a third portion of the human PAH gene.

A18. The template RNA of embodiment A17, wherein the gRNA spacer has a nucleotide sequence comprising TGGGTCGTAGCGAACTGAGA (SEQ ID NO: 16102).

A19. The template RNA of any of the preceding embodiments, wherein the heterologous object sequence comprises a sequence of at least 10 nucleotides from the 3' end of a sequence according to tcactcaagcctgtggttttggtcttaggaactttgctgccacaatacctCggcccttct (SEQ ID NO: 24863), or a sequence having 1, 2, 3, or 4 substitutions thereto.

A20. The template RNA of any of the preceding embodiments, wherein the heterologous object sequence comprises a sequence of tcactcaagcctgtggttttggtcttaggaactttgctgccacaatacctCggcccttct (SEQ ID NO: 24863), or comprises at least 20, 30, 40, of 50 nucleotides from the 3' end of said sequence, or a sequence having 1, 2, 3, or 4 substitutions thereto.

A21. The template RNA of any of the preceding embodiments, wherein the heterologous object sequence comprises a sequence of at least 10 nucleotides from the 3' end of a sequence according to tcactcaagcctgtggttttggtcttaggaactttgctgccacaatacctCggcccttct (SEQ ID NO: 24863).

A22. The template RNA of any of the preceding embodiments, wherein the heterologous object sequence comprises a sequence of tcactcaagcctgtggttttggtcttaggaactttgctgccacaatacctCggcccttct (SEQ ID NO: 24863), or comprises at least 20, 30, 40, of 50 nucleotides from the 3' end of said sequence.

A23. The template RNA of any of the preceding embodiments, wherein the PBS comprises a sequence of at least 5, 6, 7, or 8 nucleotides from the 5' end of a sequence according to cagttcgct, or a sequence having 1 substitution thereto.

A24. The template RNA of any of the preceding embodiments, wherein the PBS comprises a sequence of cagttcgct.

A25. A template RNA comprising, from 5' to 3':

(i) a gRNA spacer that is complementary to a first portion of the human PAH gene, wherein the gRNA spacer has a nucleotide sequence comprising GGGTCGTAGCGAACTGAGAA (SEQ ID NO: 16084), or a nucleotide sequence having 1, 2, or 3 substitution thereto;

(ii) a gRNA scaffold that binds a Cas domain of a gene modifying polypeptide, (iii) a heterologous object sequence comprising a mutation region to correct a mutation in a second portion of the human PAH gene, and (iv) a primer binding site (PBS) sequence comprising at least 5 bases with 100% identity to a third portion of the human PAH gene.

A26. The template RNA of embodiment A25, wherein the gRNA spacer has a nucleotide sequence comprising GGGTCGTAGCGAACTGAGAA (SEQ ID NO: 16084).

A27. The template RNA of any of the preceding embodiments, wherein the heterologous object sequence comprises a sequence of at least 9 nucleotides from the 3' end of a sequence according to tcactcaagcctgtggttttggtcttaggaactttgctgccacaatacctCggcccttc (SEQ ID NO: 24856), or a sequence having 1, 2, 3, or 4 substitutions thereto.

A28. The template RNA of any of the preceding embodiments, wherein the heterologous object sequence comprises a sequence of tcactcaagcctgtggttttggtcttaggaactttgctgccacaatacctCggcccttc (SEQ ID NO: 24856), or comprises at least 10, 20, 30, 40, or 50 nucleotides from the 3' end of said sequence, or a sequence having 1, 2, 3, or 4 substitutions thereto.

A29. The template RNA of any of the preceding embodiments, wherein the heterologous object sequence comprises a sequence of at least 9 nucleotides from the 3' end of a sequence according to tcactcaagcctgtggttttggtcttaggaactttgctgccacaatacctCggcccttc (SEQ ID NO: 24856).

A30. The template RNA of any of the preceding embodiments, wherein the heterologous object sequence comprises a sequence of tcactcaagcctgtggttttggtcttaggaactttgctgccacaatacctCggcccttc (SEQ ID NO: 24856), or comprises at least 10, 20, 30, 40, or 50 nucleotides from the 3' end of said sequence.

A31. The template RNA of any of the preceding embodiments, wherein the PBS comprises a sequence of at least 5, 6, 7, or 8 nucleotides from the 5' end of a sequence according to tcagttcgc, or a sequence having 1 substitution thereto.

A32. The template RNA of any of the preceding embodiments, wherein the PBS comprises a sequence of tcagttcgc A33. A template RNA comprising, from 5' to 3':

(i) a gRNA spacer that is complementary to a first portion of the human PAH gene, wherein the gRNA spacer has a nucleotide sequence comprising TAGCGAACTGAGAAGGGCCA (SEQ ID NO: 16011), or a nucleotide sequence having 1, 2, or 3 substitution thereto;

(ii) a gRNA scaffold that binds a Cas domain of a gene modifying polypeptide, (iii) a heterologous object sequence comprising a mutation region to correct a mutation in a second portion of the human PAH gene, and (iv) a primer binding site (PBS) sequence comprising at least 5 bases with 100% identity to a third portion of the human PAH gene.

A34. The template RNA of embodiment A33, wherein the gRNA spacer has a nucleotide sequence comprising TAGCGAACTGAGAAGGGCCA (SEQ ID NO: 16011).

A35. The template RNA of any of the preceding embodiments, wherein the heterologous object sequence comprises a sequence of at least 3 nucleotides from the 3' end of a sequence according to tcactcaagcctgtggttttggtcttaggaactttgctgccacaatacctCgg (SEQ ID NO: 24817), or a sequence having 1, 2, 3, or 4 substitutions thereto.

A36. The template RNA of any of the preceding embodiments, wherein the heterologous object sequence comprises a sequence of tcactcaagcctgtggttttggtcttaggaactttgctgccacaatacctCgg (SEQ ID NO: 24817), or comprises at least 5, 10, 20, 30, 40, or 50 nucleotides from the 3' end of said sequence, or a sequence having 1, 2, 3, or 4 substitutions thereto.

A37. The template RNA of any of the preceding embodiments, wherein the heterologous object sequence comprises a sequence of at least 3 nucleotides from the 3' end of a sequence according to tcactcaagcctgtggttttggtcttaggaactttgctgccacaatacctCgg (SEQ ID NO: 24817).

A38. The template RNA of any of the preceding embodiments, wherein the heterologous object sequence comprises a sequence of tcactcaagcctgtggttttggtcttaggaactttgctgccacaatacctCgg (SEQ ID NO: 24817), or comprises at least 5, 10, 20, 30, 40, or 50 nucleotides from the 3' end of said sequence.

A39. The template RNA of any of the preceding embodiments, wherein the PBS comprises a sequence of at least 5, 6, 7, or 8 nucleotides from the 5' end of a sequence according to cccttctca, or a sequence having 1 substitution thereto.

A40. The template RNA of any of the preceding embodiments, wherein the PBS comprises a sequence of cccttctca.

A41. A template RNA comprising, from 5' to 3':

(i) a gRNA spacer that is complementary to a first portion of the human PAH gene, wherein the gRNA spacer has a nucleotide sequence comprising ACTTTGCTGCCACAATACCT (SEQ ID NO: 16032), or a nucleotide sequence having 1, 2, or 3 substitution thereto;

(ii) a gRNA scaffold that binds a Cas domain of a gene modifying polypeptide, (iii) a heterologous object sequence comprising a mutation region to correct a mutation in a second portion of the human PAH gene, and (iv) a primer binding site (PBS) sequence comprising at least 5 bases with 100% identity to a third portion of the human PAH gene.

A42. The template RNA of embodiment A41, wherein the gRNA spacer has a nucleotide sequence comprising ACTTTGCTGCCACAATACCT (SEQ ID NO: 16032).

A43. The template RNA of any of the preceding embodiments, wherein the heterologous object sequence comprises a sequence of at least 4 nucleotides from the 3' end of a sequence according to caagacctcaatcctttgggtgtatgggtcgtagcgaactgagaagggccGagg (SEQ ID NO: 24825), or a sequence having 1, 2, 3, or 4 substitutions thereto.

A44. The template RNA of any of the preceding embodiments, wherein the heterologous object sequence comprises a sequence of caagacctcaatcctttgggtgtatgggtcgtagcgaactgagaagggccGagg (SEQ ID NO: 24825), or comprises at least 5, 10, 20, 30, 40, or 50 nucleotides from the 3' end of said sequence, or a sequence having 1, 2, 3, or 4 substitutions thereto.

A45. The template RNA of any of the preceding embodiments, wherein the heterologous object sequence comprises a sequence of at least 4 nucleotides from the 3' end of a sequence according to caagacctcaatcctttgggtgtatgggtcgtagcgaactgagaagggccGagg (SEQ ID NO: 24825).

A46. The template RNA of any of the preceding embodiments, wherein the heterologous object sequence comprises a sequence of caagacctcaatcctttgggtgtatgggtcgtagcgaactgagaagggccGagg (SEQ ID NO: 24825), or comprises at least 5, 10, 20, 30, 40, or 50 nucleotides from the 3' end of said sequence.

A47. The template RNA of any of the preceding embodiments, wherein the PBS comprises a sequence of at least 5, 6, 7, 8, 9, 10, or 15 nucleotides from the 5' end of a sequence according to tattgtggcagcaaagt (SEQ ID NO: 37633), or a sequence having 1 substitution thereto.

A48. The template RNA of any of the preceding embodiments, wherein the PBS comprises a sequence of tattgtggcagcaaagt (SEQ ID NO: 37633).

A49. The template RNA of any of the preceding embodiments, wherein the gRNA scaffold has a sequence according to GTTTTAGAGCTAGAAATAGCAAGTTAAAATAAGGCTAGTCCGTTATCAACTTGAAAA AGTGGCACCGAGTCGGTGC (SEQ ID NO: 37627), or a sequence having at least 90% identity thereto.

A50. The template RNA of any of the preceding embodiments, wherein the gRNA scaffold has a sequence according to

```
                                        (SEQ ID NO: 37627)
GTTTTAGAGCTAGAAATAGCAAGTTAAAATAAGGCTAGTCCGTTATCAA
CTTGAAAAAGTGGCACCGAGTCGGTGC.
```

A51. The template RNA of any of the preceding embodiments, wherein the mutation region comprises a single nucleotide.

A52. The template RNA of any of embodiments A1-51, wherein the mutation region is at least two nucleotides in length.

A53. The template RNA of any of the preceding embodiments, wherein the mutation region is up to 20 nucleotides in length and comprises one, two, or three sequence differences relative to the second portion of the human PAH gene.

A54. The template RNA of any of embodiments A1-53, wherein the mutation region comprises a first region designed to correct a pathogenic mutation in the PAH gene and a second region designed to inactivate a PAM sequence.

A55. The template RNA of any of embodiments A1-54, wherein the mutation region comprises a first region designed to correct a pathogenic mutation in the PAH gene and a second region designed to introduce a silent substitution.

A56. The template RNA of any of the preceding embodiments, which is configured to edit a pathogenic R408W mutation in the human PAH gene.

A57. The template RNA of embodiment A56, which is configured to convert an R408W mutation to arginine.

A58. The template RNA of any of the preceding embodiments, which comprises one or more chemically modified nucleotides.

A59. A gene modifying system comprising:

a template RNA of any of the preceding embodiments, and a gene modifying polypeptide, or a nucleic acid encoding the gene modifying polypeptide.

A60. The gene modifying system of embodiment A59, wherein the gene modifying polypeptide comprises an RT domain having a sequence according to SEQ ID NO: 8,003, or a sequence having at least 70%, 80%, 85%, 90%, 95%, 98%, or 99% identity thereto.

A61. The gene modifying system of embodiment A59, wherein the gene modifying polypeptide comprises an RT domain having a sequence according to SEQ ID NO: 8,020, or a sequence having at least 70%, 80%, 85%, 90%, 95%, 98%, or 99% identity thereto.

A62. The gene modifying system of embodiment 5A9, wherein the gene modifying polypeptide comprises an RT domain having a sequence according to SEQ ID NO: 8,074, or a sequence having at least 70%, 80%, 85%, 90%, 95%, 98%, or 99% identity thereto.

A63. The gene modifying system of embodiment A59, wherein the gene modifying polypeptide comprises an RT domain having a sequence according to SEQ ID NO: 8,113, or a sequence having at least 70%, 80%, 85%, 90%, 95%, 98%, or 99% identity thereto.

A64. The gene modifying system of embodiment A59, wherein the gene modifying polypeptide comprises DNA binding domain having a sequence of a Cas9 nickase comprising an N863A mutation, e.g., a sequence according to SEQ ID NO: 11,096, or a sequence having at least 70%, 80%, 85%, 90%, 95%, 98%, or 99% identity thereto.

A65. The gene modifying system of embodiment A59, which produces a first nick in a first strand of the human PAH gene.

A66. The gene modifying system of embodiment A65, which further comprises a second strand-targeting gRNA that directs a second nick to the second strand of the human PAH gene.

A67. The gene modifying system of embodiment A66, wherein the first nick and the second nick are 80-120 nucleotides apart.

A68. The gene modifying system of embodiment A66, wherein the template RNA and the second strand-targeting gRNA are configured to produce an outward nick orientation.

A69. The gene modifying system of embodiment A66, wherein the second strand-targeting gRNA comprises a spacer sequence that is complementary to a human PAH gene having a disease mutation or a wild-type sequence.

A70. A method for modifying a target site in the human PAH gene in a cell, the method comprising contacting the cell with the gene modifying system of embodiment 59, thereby modifying the target site in the human PAH gene in a cell.

A71. The method of embodiment A70, wherein correction of the mutation occurs in at least 30% of target nucleic acids.

A72. A method for treating a subject having a disease or condition associated with a mutation in the human PAH gene, wherein the disease or condition is phenylketonuria (PKU) or hyperphenylalaninemia (e.g., mild or severe hyperphenylalaninemia), the method comprising administering to the subject the gene modifying system of embodiment 59, thereby treating the subject having a disease or condition associated with a mutation in the human PAH gene.

BRIEF DESCRIPTION OF THE DRAWINGS

FIGS. 30A-3011 are heat maps showing percent rewriting for each combination of template RNA and second strand-targeting RNA following mRNA delivery of gene modifying systems to primary cyno hepatocytes.

FIG. 31B discloses SEQ ID NOS 37642-37649, respectively, in order of appearance.

FIG. 32B discloses SEQ ID NOS 37650-37657, respectively, in order of appearance.

FIG. 33B discloses SEQ ID NOS 37658-37665, respectively, in order of appearance.

DETAILED DESCRIPTION

Definitions

Figure 1:
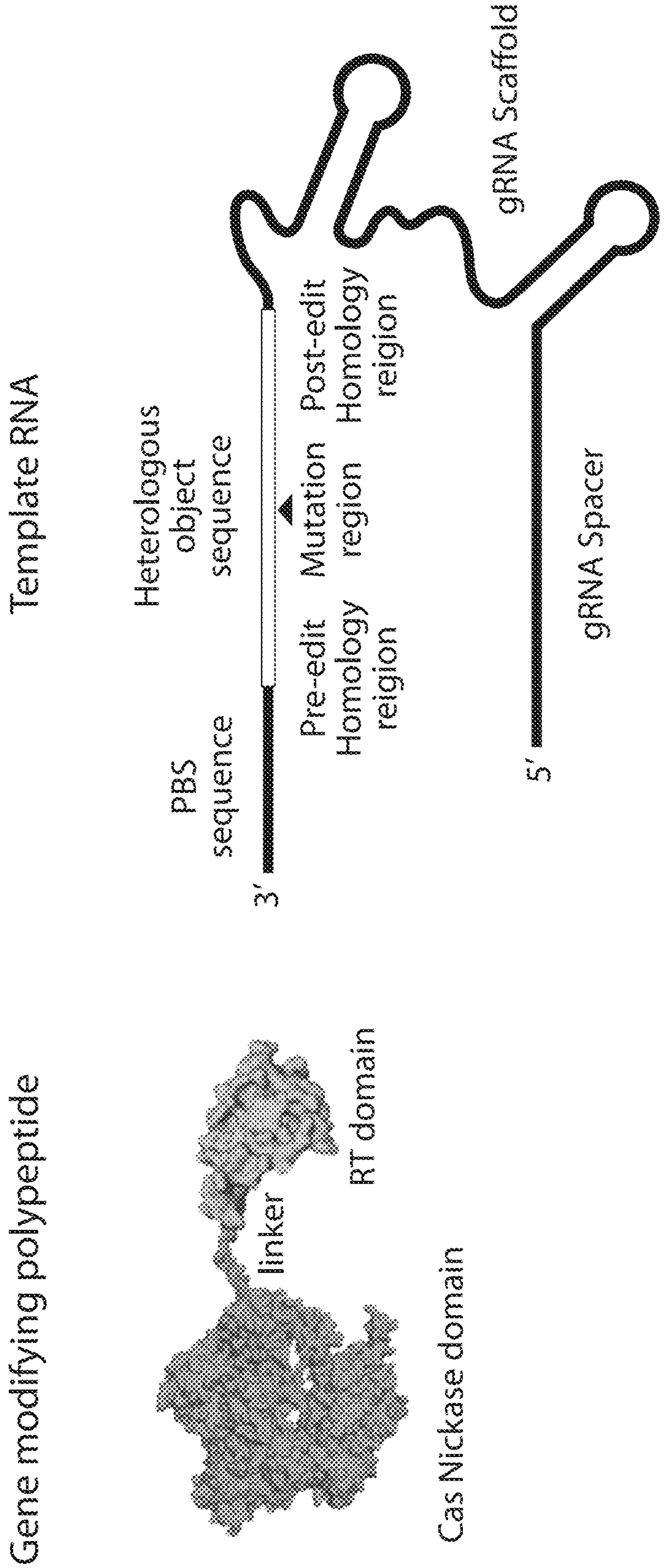
FIG. 1 depicts a gene modifying system as described herein. The left hand diagram shows the gene modifying polypeptide, which comprises a Cas nickase domain (e.g., spCas9 N863A) and a reverse transcriptase domain (RT domain) which are linked by a linker. The right hand diagram shows the template RNA which comprises, from 5' to 3', a gRNA spacer, a gRNA scaffold, a heterologous object sequence, and a primer binding site sequence (PBS sequence). The heterologous object sequence can comprise a mutation region that comprises one or more sequence differences relative to the target site. The heterologous object sequence can also comprise a pre-edit homology region and a post-edit homology region, which flank the mutation region. Without wishing to be bound by theory, it is thought that the gRNA spacer of the template RNA binds to the second strand of a target site in the genome, and the gRNA scaffold of the template RNA binds to the gene modifying polypeptide, e.g., localizing the gene modifying polypeptide to the target site in the genome. It is thought that the Cas domain of the gene modifying polypeptide nicks the target site (e.g., the first strand of the target site), e.g., allowing the PBS sequence to bind to a sequence adjacent to the site to be altered on the first strand of the target site. It is thought that the RT domain of the gene modifying polypeptide uses the first strand of the target site that is bound to the complementary sequence comprising the PBS sequence of the template RNA as a primer and the heterologous object sequence of the template RNA as a template to, e.g., polymerize a sequence complementary to the heterologous object sequence. Without wishing to be bound by theory, it is thought that reverse transcription can then proceed through the pre-edit homology region, then through the mutation region, and then through the post-edit homology region, thereby producing a DNA strand comprising a mutation specified by the heterologous object sequence.

The term "expression cassette," as used herein, refers to a nucleic acid construct comprising nucleic acid elements sufficient for the expression of the nucleic acid molecule of the instant invention.

A "gRNA spacer", as used herein, refers to a portion of a nucleic acid that has complementarity to a target nucleic acid and can, together with a gRNA scaffold, target a Cas protein to the target nucleic acid.

A "gRNA scaffold", as used herein, refers to a portion of a nucleic acid that can bind a Cas protein and can, together with a gRNA spacer, target the Cas protein to the target nucleic acid. In some embodiments, the gRNA scaffold comprises a crRNA sequence, tetraloop, and tracrRNA sequence.

A "gene modifying polypeptide", as used herein, refers to a polypeptide comprising a retroviral reverse transcriptase, or a polypeptide comprising an amino acid sequence having at least 75%, 80%, 85%, 90%, 95%, 96%, 97%, 98%, or 99% amino acid sequence identity to a retroviral reverse transcriptase, which is capable of integrating a nucleic acid sequence (e.g., a sequence provided on a template nucleic acid) into a target DNA molecule (e.g., in a mammalian host cell, such as a genomic DNA molecule in the host cell). In some embodiments, the gene modifying polypeptide is capable of integrating the sequence substantially without relying on host machinery. In some embodiments, the gene modifying polypeptide integrates a sequence into a random position in a genome, and in some embodiments, the gene modifying polypeptide integrates a sequence into a specific target site. In some embodiments, a gene modifying polypeptide includes one or more domains that, collectively, facilitate 1) binding the template nucleic acid, 2) binding the target DNA molecule, and 3) facilitate integration of the at least a portion of the template nucleic acid into the target DNA. Gene modifying polypeptides include both naturally occurring polypeptides as well as engineered variants of the foregoing, e.g., having one or more amino acid substitutions to the naturally occurring sequence. Gene modifying polypeptides also include heterologous constructs, e.g., where one or more of the domains recited above are heterologous to each other, whether through a heterologous fusion (or other conjugate) of otherwise wild-type domains, as well as fusions of modified domains, e.g., by way of replacement or fusion of a heterologous sub-domain or other substituted domain. Exemplary gene modifying polypeptides, and systems comprising them and methods of using them, that can be used in the methods provided herein are described, e.g., in PCT/US2021/020948, which is incorporated herein by reference with respect to gene modifying polypeptides that comprise a retroviral reverse transcriptase domain. In some embodiments, a gene modifying polypeptide integrates a sequence into a gene. In some embodiments, a gene modifying polypeptide integrates a sequence into a sequence outside of a gene. A "gene modifying system," as used herein, refers to a system comprising a gene modifying polypeptide and a template nucleic acid.

The term "domain" as used herein refers to a structure of a biomolecule that contributes to a specified function of the biomolecule. A domain may comprise a contiguous region (e.g., a contiguous sequence) or distinct, non-contiguous regions (e.g., non-contiguous sequences) of a biomolecule. Examples of protein domains include, but are not limited to, an endonuclease domain, a DNA binding domain, a reverse transcription domain; an example of a domain of a nucleic acid is a regulatory domain, such as a transcription factor binding domain. In some embodiments, a domain (e.g., a Cas domain) can comprise two or more smaller domains (e.g., a DNA binding domain and an endonuclease domain).

As used herein, the term "exogenous", when used with reference to a biomolecule (such as a nucleic acid sequence or polypeptide) means that the biomolecule was introduced into a host genome, cell or organism by the hand of man. For example, a nucleic acid that is as added into an existing genome, cell, tissue or subject using recombinant DNA techniques or other methods is exogenous to the existing nucleic acid sequence, cell, tissue or subject.

As used herein, "first strand" and "second strand", as used to describe the individual DNA strands of target DNA, distinguish the two DNA strands based upon which strand the reverse transcriptase domain initiates polymerization, e.g., based upon where target primed synthesis initiates. The first strand refers to the strand of the target DNA upon which the reverse transcriptase domain initiates polymerization, e.g., where target primed synthesis initiates. The second strand refers to the other strand of the target DNA. First and second strand designations do not describe the target site DNA strands in other respects; for example, in some embodiments the first and second strands are nicked by a polypeptide described herein, but the designations 'first' and 'second' strand have no bearing on the order in which such nicks occur.

The term "heterologous," as used herein to describe a first element in reference to a second element means that the first element and second element do not exist in nature disposed as described. For example, a heterologous polypeptide, nucleic acid molecule, construct or sequence refers to (a) a polypeptide, nucleic acid molecule or portion of a polypeptide or nucleic acid molecule sequence that is not native to a cell in which it is expressed, (b) a polypeptide or nucleic acid molecule or portion of a polypeptide or nucleic acid molecule that has been altered or mutated relative to its native state, or (c) a polypeptide or nucleic acid molecule with an altered expression as compared to the native expression levels under similar conditions. For example, a heterologous regulatory sequence (e.g., promoter, enhancer) may be used to regulate expression of a gene or a nucleic acid molecule in a way that is different than the gene or a nucleic acid molecule is normally expressed in nature. In another example, a heterologous domain of a polypeptide or nucleic acid sequence (e.g., a DNA binding domain of a polypeptide or nucleic acid encoding a DNA binding domain of a polypeptide) may be disposed relative to other domains or may be a different sequence or from a different source, relative to other domains or portions of a polypeptide or its encoding nucleic acid. In certain embodiments, a heterologous nucleic acid molecule may exist in a native host cell genome, but may have an altered expression level or have a different sequence or both. In other embodiments, heterologous nucleic acid molecules may not be endogenous to a host cell or host genome but instead may have been introduced into a host cell by transformation (e.g., transfection, electroporation), wherein the added molecule may integrate into the host genome or can exist as extra-chromosomal genetic material either transiently (e.g., mRNA) or semi-stably for more than one generation (e.g., episomal viral vector, plasmid or other self-replicating vector).

As used herein, "insertion" of a sequence into a target site refers to the net addition of DNA sequence at the target site, e.g., where there are new nucleotides in the heterologous object sequence with no cognate positions in the unedited target site. In some embodiments, a nucleotide alignment of the PBS sequence and heterologous object sequence to the target nucleic acid sequence would result in an alignment gap in the target nucleic acid sequence.

As used herein, a "deletion" generated by a heterologous object sequence in a target site refers to the net deletion of DNA sequence at the target site, e.g., where there are nucleotides in the unedited target site with no cognate positions in the heterologous object sequence. In some embodiments, a nucleotide alignment of the PBS sequence and heterologous object sequence to the target nucleic acid sequence would result in an alignment gap in the molecule comprising the PBS sequence and heterologous object sequence.

The term "inverted terminal repeats" or "ITRs" as used herein refers to AAV viral cis-elements named so because of their symmetry. These elements promote efficient multiplication of an AAV genome. It is hypothesized that the minimal elements for ITR function are a Rep-binding site (RBS; 5'-GCGCGCTCGCTCGCTC-3' for AAV2; SEQ ID NO: 4601) and a terminal resolution site (TRS; 5'-AGTTGG-3' for AAV2) plus a variable palindromic sequence allowing for hairpin formation. According to the present invention, an ITR comprises at least these three elements (RBS, TRS, and sequences allowing the formation of an hairpin). In addition, in the present invention, the term "ITR" refers to ITRs of known natural AAV serotypes (e.g. ITR of a serotype 1, 2, 3, 4, 5, 6, 7, 8, 9, 10 or 11 AAV), to chimeric ITRs formed by the fusion of ITR elements derived from different serotypes, and to functional variants thereof. "Functional variant" refers to a sequence presenting a sequence identity of at least 80%, 85%, 90%, preferably of at least 95% with a known ITR and allowing multiplication of the sequence that includes said ITR in the presence of Rep proteins.

The term "mutation region," as used herein, refers to a region in a template RNA having one or more sequence difference relative to the corresponding sequence in a target nucleic acid. The sequence difference may comprise, for example, a substitution, insertion, frameshift, or deletion.

The term "mutated" when applied to nucleic acid sequences means that nucleotides in a nucleic acid sequence are inserted, deleted, or changed compared to a reference (e.g., native) nucleic acid sequence. A single alteration may be made at a locus (a point mutation), or multiple nucleotides may be inserted, deleted, or changed at a single locus. In addition, one or more alterations may be made at any number of loci within a nucleic acid sequence. A nucleic acid sequence may be mutated by any method known in the art.

"Nucleic acid molecule" refers to both RNA and DNA molecules including, without limitation, complementary DNA ("cDNA"), genomic DNA ("gDNA"), and messenger RNA ("mRNA"), and also includes synthetic nucleic acid molecules, such as those that are chemically synthesized or recombinantly produced, such as RNA templates, as described herein. The nucleic acid molecule can be double-stranded or single-stranded, circular, or linear. If single-stranded, the nucleic acid molecule can be the sense strand or the antisense strand. Unless otherwise indicated, and as an example for all sequences described herein under the general format "SEQ ID NO:," or "nucleic acid comprising SEQ ID NO:1" refers to a nucleic acid, at least a portion which has either (i) the sequence of SEQ ID NO:1, or (ii) a sequence complimentary to SEQ ID NO:1. The choice between the two is dictated by the context in which SEQ ID NO:1 is used. For instance, if the nucleic acid is used as a probe, the choice between the two is dictated by the requirement that the probe be complementary to the desired target. Nucleic acid sequences of the present disclosure may be modified chemically or biochemically or may contain non-natural or derivatized nucleotide bases, as will be readily appreciated by those of skill in the art. Such modifications include, for example, labels, methylation, substitution of one or more naturally occurring nucleotides with an analog, inter-nucleotide modifications such as uncharged linkages (for example, methyl phosphonates, phosphotriesters, phosphoramidates, carbamates, etc.), charged linkages (for example, phosphorothioates, phosphorodithioates, etc.), pendant moieties, (for example, polypeptides), intercalators (for example, acridine, psoralen, etc.), chelators, alkylators, and modified linkages (for example, alpha anomeric nucleic acids, etc.). Also included are chemically modified bases (see, for example, Table 13), backbones (see, for example, Table 14), and modified caps (see, for example, Table 15). Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of a molecule, e.g., peptide nucleic acids (PNAs). Other modifications can include, for example, analogs in which the ribose ring contains a bridging moiety or other structure such as modifications found in "locked" nucleic acids (LNAs). In various embodiments, the nucleic acids are in operative association with additional genetic elements, such as tissue-specific expression-control sequence(s) (e.g., tissue-specific promoters and tissue-specific microRNA recognition sequences), as well as additional elements, such as inverted repeats (e.g., inverted terminal repeats, such as elements from or derived from viruses, e.g., AAV ITRs) and tandem repeats, inverted repeats/direct repeats, homology regions (segments with various degrees of homology to a target DNA), untranslated regions (UTRs) (5', 3', or both 5' and 3' UTRs), and various combinations of the foregoing. The nucleic acid elements of the systems provided by the invention can be provided in a variety of topologies, including single-stranded, double-stranded, circular, linear, linear with open ends, linear with closed ends, and particular versions of these, such as doggybone DNA (dbDNA), closed-ended DNA (ceDNA).

As used herein, a "gene expression unit" is a nucleic acid sequence comprising at least one regulatory nucleic acid sequence operably linked to at least one effector sequence. A first nucleic acid sequence is operably linked with a second nucleic acid sequence when the first nucleic acid sequence is placed in a functional relationship with the second nucleic acid sequence. For instance, a promoter or enhancer is operably linked to a coding sequence if the promoter or enhancer affects the transcription or expression of the coding sequence. Operably linked DNA sequences may be contiguous or non-contiguous. Where necessary to join two protein-coding regions, operably linked sequences may be in the same reading frame.

The terms "host genome" or "host cell", as used herein, refer to a cell and/or its genome into which protein and/or genetic material has been introduced. It should be understood that such terms are intended to refer not only to the particular subject cell and/or genome, but to the progeny of such a cell and/or the genome of the progeny of such a cell. Because certain modifications may occur in succeeding generations due to either mutation or environmental influences, such progeny may not, in fact, be identical to the parent cell, but are still included within the scope of the term "host cell" as used herein. A host genome or host cell may be an isolated cell or cell line grown in culture, or genomic material isolated from such a cell or cell line, or may be a host cell or host genome which composing living tissue or an organism. In some instances, a host cell may be an animal cell or a plant cell, e.g., as described herein. In certain instances, a host cell may be a mammalian cell, a human cell, avian cell, reptilian cell, bovine cell, horse cell, pig cell, goat cell, sheep cell, chicken cell, or turkey cell. In certain instances, a host cell may be a corn cell, soy cell, wheat cell, or rice cell.

As used herein, "operative association" describes a functional relationship between two nucleic acid sequences, such as a 1) promoter and 2) a heterologous object sequence, and means, in such example, the promoter and heterologous object sequence (e.g., a gene of interest) are oriented such that, under suitable conditions, the promoter drives expression of the heterologous object sequence. For instance, a template nucleic acid carrying a promoter and a heterologous object sequence may be single-stranded, e.g., either the (+) or (−) orientation. An "operative association" between the promoter and the heterologous object sequence in this template means that, regardless of whether the template nucleic acid will be transcribed in a particular state, when it is in the suitable state (e.g., is in the (+) orientation, in the presence of required catalytic factors, and NTPs, etc.), it is accurately transcribed. Operative association applies analogously to other pairs of nucleic acids, including other tissue-specific expression control sequences (such as enhancers, repressors and microRNA recognition sequences), IR/DR, ITRs, UTRs, or homology regions and heterologous object sequences or sequences encoding a retroviral RT domain.

The term "primer binding site sequence" or "PBS sequence," as used herein, refers to a portion of a template RNA capable of binding to a region comprised in a target nucleic acid sequence. In some instances, a PBS sequence is a nucleic acid sequence comprising at least 3, 4, 5, 6, 7, or 8 bases with 100% identity to the region comprised in the target nucleic acid sequence. In some embodiments the primer region comprises at least 5, 6, 7, 8 bases with 100% identity to the region comprised in the target nucleic acid sequence. Without wishing to be bound by theory, in some embodiments when a template RNA comprises a PBS sequence and a heterologous object sequence, the PBS sequence binds to a region comprised in a target nucleic acid sequence, allowing a reverse transcriptase domain to use that region as a primer for reverse transcription, and to use the heterologous object sequence as a template for reverse transcription.

As used herein, a "stem-loop sequence" refers to a nucleic acid sequence (e.g., RNA sequence) with sufficient self-complementarity to form a stem-loop, e.g., having a stem comprising at least two (e.g., 3, 4, 5, 6, 7, 8, 9, or 10) base pairs, and a loop with at least three (e.g., four) base pairs. The stem may comprise mismatches or bulges.

As used herein, a "tissue-specific expression-control sequence" means nucleic acid elements that increase or decrease the level of a transcript comprising the heterologous object sequence in a target tissue in a tissue-specific manner, e.g., preferentially in on-target tissue(s), relative to off-target tissue(s). In some embodiments, a tissue-specific expression-control sequence preferentially drives or represses transcription, activity, or the half-life of a transcript comprising the heterologous object sequence in the target tissue in a tissue-specific manner, e.g., preferentially in an on-target tissue(s), relative to an off-target tissue(s). Exemplary tissue-specific expression-control sequences include tissue-specific promoters, repressors, enhancers, or combinations thereof, as well as tissue-specific microRNA recognition sequences. Tissue specificity refers to on-target (tissue(s) where expression or activity of the template nucleic acid is desired or tolerable) and off-target (tissue(s) where expression or activity of the template nucleic acid is not desired or is not tolerable). For example, a tissue-specific promoter drives expression preferentially in on-target tissues, relative to off-target tissues. In contrast, a microRNA that binds the tissue-specific microRNA recognition sequences is preferentially expressed in off-target tissues, relative to on-target tissues, thereby reducing expression of a template nucleic acid in off-target tissues. Accordingly, a promoter and a microRNA recognition sequence that are specific for the same tissue, such as the target tissue, have contrasting functions (promote and repress, respectively, with concordant expression levels, i.e., high levels of the microRNA in off-target tissues and low levels in on-target tissues, while promoters drive high expression in on-target tissues and low expression in off-target tissues) with regard to the transcription, activity, or half-life of an associated sequence in that tissue.

TABLE OF CONTENTS

1) Introduction
2) Gene modifying systems
  a) Polypeptide components of gene modifying systems
    i) Writing domain
    ii) Endonuclease domains and DNA binding domains
      (1) Gene modifying polypeptides comprising Cas domains
      (2) TAL Effectors and Zinc Finger Nucleases
    iii) Linkers
    iv) Localization sequences for gene modifying systems
    v) Evolved Variants of Gene Modifying Polypeptides and Systems
    vi) Inteins
    vii) Additional domains
  b) Template nucleic acids
    i) gRNA spacer and gRNA scaffold
    ii) Heterologous object sequence
    iii) PBS sequence
    iv) Exemplary Template Sequences
  c) gRNAs with inducible activity
  d) Circular RNAs and Ribozymes in Gene Modifying Systems
  e) Target Nucleic Acid Site
  f) Second strand nicking 3) Production of Compositions and Systems
4) Therapeutic Applications
5) Administration and Delivery
   a) Tissue Specific Activity/Administration
      i) Promoters
      ii) microRNAs
   b) Viral vectors and components thereof
   c) AAV Administration
   d) Lipid Nanoparticles
6) Kits, Articles of Manufacture, and Pharmaceutical Compositions
7) Chemistry, Manufacturing, and Controls (CMC)

INTRODUCTION

This disclosure relates to methods for treating phenylketonuria (PKU) and compositions for targeting, editing, modifying or manipulating a DNA sequence (e.g., inserting a heterologous object sequence into a target site of a mammalian genome) at one or more locations in a DNA sequence in a cell, tissue or subject, e.g., in vivo or in vitro. The heterologous object DNA sequence may include, e.g., a substitution.

More specifically, the disclosure provides methods for treating PKU using reverse transcriptase-based systems for altering a genomic DNA sequence of interest, e.g., by inserting, deleting, or substituting one or more nucleotides into/from the sequence of interest.

The disclosure provides, in part, methods for treating PKU using a gene modifying system comprising a gene modifying polypeptide component and a template nucleic acid (e.g., template RNA) component. In some embodiments, a gene modifying system can be used to introduce an alteration into a target site in a genome. In some embodiments, the gene modifying polypeptide component comprises a writing domain (e.g., a reverse transcriptase domain), a DNA-binding domain, and an endonuclease domain (e.g., nickase domain). In some embodiments, the template nucleic acid (e.g., template RNA) comprises a sequence (e.g., a gRNA spacer) that binds a target site in the genome (e.g., that binds to a second strand of the target site), a sequence (e.g., a gRNA scaffold) that binds the gene modifying polypeptide component, a heterologous object sequence, and a PBS sequence. Without wishing to be bound by theory, it is thought that the template nucleic acid (e.g., template RNA) binds to the second strand of a target site in the genome, and binds to the gene modifying polypeptide component (e.g., localizing the polypeptide component to the target site in the genome). It is thought that the endonuclease (e.g., nickase) of the gene modifying polypeptide component cuts the target site (e.g., the first strand of the target site), e.g., allowing the PBS sequence to bind to a sequence adjacent to the site to be altered on the first strand of the target site. It is thought that the writing domain (e.g., reverse transcriptase domain) of the polypeptide component uses the first strand of the target site that is bound to the complementary sequence comprising the PBS sequence of the template nucleic acid as a primer and the heterologous object sequence of the template nucleic acid as a template to, e.g., polymerize a sequence complementary to the heterologous object sequence. Without wishing to be bound by theory, it is thought that selection of an appropriate heterologous object sequence can result in substitution, deletion, and/or insertion of one or more nucleotides at the target site.

Gene Modifying Systems

In some embodiments, a gene modifying system described herein comprises: (A) a gene modifying polypeptide or a nucleic acid encoding the gene modifying polypeptide, wherein the gene modifying polypeptide comprises (i) a reverse transcriptase domain, and either (x) an endonuclease domain that contains DNA binding functionality or (y) an endonuclease domain and separate DNA binding domain; and (B) a template RNA. A gene modifying polypeptide, in some embodiments, acts as a substantially autonomous protein machine capable of integrating a template nucleic acid sequence into a target DNA molecule (e.g., in a mammalian host cell, such as a genomic DNA molecule in the host cell), substantially without relying on host machinery. For example, the gene modifying protein may comprise a DNA-binding domain, a reverse transcriptase domain, and an endonuclease domain. In some embodiments, the DNA-binding function may involve an RNA component that directs the protein to a DNA sequence, e.g., a gRNA spacer. In other embodiments, the gene modifying polypeptide may comprise a reverse transcriptase domain and an endonuclease domain. The RNA template element of a gene modifying system is typically heterologous to the gene modifying polypeptide element and provides an object sequence to be inserted (reverse transcribed) into the host genome. In some embodiments, the gene modifying polypeptide is capable of target primed reverse transcription. In some embodiments, the gene modifying polypeptide is capable of second-strand synthesis.

In some embodiments the gene modifying system is combined with a second polypeptide. In some embodiments, the second polypeptide may comprise an endonuclease domain. In some embodiments, the second polypeptide may comprise a polymerase domain, e.g., a reverse transcriptase domain. In some embodiments, the second polypeptide may comprise a DNA-dependent DNA polymerase domain. In some embodiments, the second polypeptide aids in completion of the genome edit, e.g., by contributing to second-strand synthesis or DNA repair resolution.

A functional gene modifying polypeptide can be made up of unrelated DNA binding, reverse transcription, and endonuclease domains. This modular structure allows combining of functional domains, e.g., dCas9 (DNA binding), MMLV reverse transcriptase (reverse transcription), FokI (endonuclease). In some embodiments, multiple functional domains may arise from a single protein, e.g., Cas9 or Cas9 nickase (DNA binding, endonuclease).

In some embodiments, a gene modifying polypeptide includes one or more domains that, collectively, facilitate 1) binding the template nucleic acid, 2) binding the target DNA molecule, and 3) facilitate integration of the at least a portion of the template nucleic acid into the target DNA. In some embodiments, the gene modifying polypeptide is an engineered polypeptide that comprises one or more amino acid substitutions to a corresponding naturally occurring sequence. In some embodiments, the gene modifying polypeptide comprises two or more domains that are heterologous relative to each other, e.g., through a heterologous fusion (or other conjugate) of otherwise wild-type domains, or well as fusions of modified domains, e.g., by way of replacement or fusion of a heterologous sub-domain or other substituted domain. For instance, in some embodiments, one or more of: the RT domain is heterologous to the DBD; the DBD is heterologous to the endonuclease domain; or the RT domain is heterologous to the endonuclease domain.

In some embodiments, a template RNA molecule for use in the system comprises, from 5' to 3' (1) a gRNA spacer; (2) a gRNA scaffold; (3) heterologous object sequence (4) a primer binding site (PBS) sequence. In some embodiments:

(1) Is a gRNA spacer of ~18-22 nt, e.g., is 20 nt (2) Is a gRNA scaffold comprising one or more hairpin loops, e.g., 1, 2, of 3 loops for associating the template with a Cas domain, e.g., a nickase Cas9 domain. In some embodiments, the gRNA scaffold comprises the sequence, from 5' to 3', GTTTTAGAGCTAGAAATAGCAAGTTAAAATAAGGCTAGTCCGTTATCAACTTGAAAAAGTGGGACCGAGTCGGTCC (SEQ ID NO: 5008).

(3) In some embodiments, the heterologous object sequence is, e.g., 7-74, e.g., 10-20, 20-30, 30-40, 40-50, 50-60, 60-70, or 70-80 nt or, 80-90 nt in length. In some embodiments, the first (most 5') base of the sequence is not C.

(4) In some embodiments, the PBS sequence that binds the target priming sequence after nicking occurs is e.g., 3-20 nt, e.g., 7-15 nt, e.g., 12-14 nt. In some embodiments, the PBS sequence has 40-60% GC content.

In some embodiments, a second gRNA associated with the system may help drive complete integration. In some embodiments, the second gRNA may target a location that is 0-200 nt away from the first-strand nick, e.g., 0-50, 50-100, 100-200 nt away from the first-strand nick. In some embodiments, the second gRNA can only bind its target sequence after the edit is made, e.g., the gRNA binds a sequence present in the heterologous object sequence, but not in the initial target sequence.

In some embodiments, a gene modifying system described herein is used to make an edit in HEK293, K562, U2OS, or HeLa cells. In some embodiment, a gene modifying system is used to make an edit in primary cells, e.g., primary cortical neurons from E18.5 mice.

In some embodiments, a gene modifying polypeptide as described herein comprises a reverse transcriptase or RT domain (e.g., as described herein) that comprises a MoMLV RT sequence or variant thereof. In embodiments, the MoMLV RT sequence comprises one or more mutations selected from D200N, L603W, T330P, T306K, W313F, D524G, E562Q, D583N, P51L, S67R, E67K, T197A, H204R, E302K, F309N, L435G, N454K, H594Q, D653N, R110S, and K103L. In embodiments, the MoMLV RT sequence comprises a combination of mutations, such as D200N, L603W, and T330P, optionally further including T306K and/or W313F.

In some embodiments, an endonuclease domain (e.g., as described herein) nCas9, e.g., comprising an N863A mutation (e.g., in spCas9) or a H840A mutation.

In some embodiments, the heterologous object sequence (e.g., of a system as described herein) is about 1-50, 50-100, 100-200, 200-300, 300-400, 400-500, 500-600, 600-700, 700-800, 800-900, 900-1000, or more, nucleotides in length.

In some embodiments, the RT and endonuclease domains are joined by a flexible linker, e.g., comprising the amino acid sequence SGGSSGGSSGSETPGTSESATPESSGGSSGGSS (SEQ ID NO: 5006).

In some embodiments, the endonuclease domain is N-terminal relative to the RT domain. In some embodiments, the endonuclease domain is C-terminal relative to the RT domain.

In some embodiments, the system incorporates a heterologous object sequence into a target site by TPRT, e.g., as described herein.

In some embodiments, a gene modifying polypeptide comprises a DNA binding domain. In some embodiments, a gene modifying polypeptide comprises an RNA binding domain. In some embodiments, the RNA binding domain comprises an RNA binding domain of B-box protein, MS2 coat protein, dCas, or an element of a sequence of a table herein. In some embodiments, the RNA binding domain is capable of binding to a template RNA with greater affinity than a reference RNA binding domain.

In some embodiments, a gene modifying system is capable of producing an insertion into the target site of at least 45, 50, 55, 60, 65, 70, 75, 80, 85, 90, 95, or 100 nucleotides (and optionally no more than 500, 400, 300, 200, or 100 nucleotides). In some embodiments, a gene modifying system is capable of producing an insertion into the target site of at least 1, 2, 3, 4, 5, 6, 7, 8, 9, 10, 15, 20, 25, 30, 35, 40, 45, 50, 55, 60, 65, 70, 75, 80, 85, 90, 95, or 100 nucleotides (and optionally no more than 500, 400, 300, 200, or 100 nucleotides). In some embodiments, a gene modifying system is capable of producing an insertion into the target site of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases). In some embodiments, a gene modifying system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a gene modifying system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a gene modifying system is capable of producing a deletion of at least 1, 2, 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, or 200 nucleotides (and optionally no more than 500, 400, 300, or 200 nucleotides). In some embodiments, a gene modifying system is capable of producing a deletion of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases). In some embodiments, a gene modifying system is capable of producing a substitution into the target site of at least 1, 2, 3, 4, 5, 6, 7, 8, 9, 10, 15, 20, 25, 30, 35, 40, 45, 50, 60, 70, 80, 90, or 100 or more nucleotides. In some embodiments, a gene modifying system is capable of producing a substitution in the target site of 1-2, 2-3, 3-4, 4-5, 5-10, 10-15, 15-20, 20-30, 30-40, 40-50, 50-60, 60-70, 70-80, 80-90, or 90-100 nucleotides.

In some embodiments, the substitution is a transition mutation. In some embodiments, the substitution is a transversion mutation. In some embodiments, the substitution converts an adenine to a thymine, an adenine to a guanine, an adenine to a cytosine, a guanine to a thymine, a guanine to a cytosine, a guanine to an adenine, a thymine to a cytosine, a thymine to an adenine, a thymine to a guanine, a cytosine to an adenine, a cytosine to a guanine, or a cytosine to a thymine.

In some embodiments, an insertion, deletion, substitution, or combination thereof, increases or decreases expression (e.g. transcription or translation) of a gene. In some embodiments, an insertion, deletion, substitution, or combination thereof, increases or decreases expression (e.g. transcription or translation) of a gene by altering, adding, or deleting sequences in a promoter or enhancer, e.g. sequences that bind transcription factors. In some embodiments, an insertion, deletion, substitution, or combination thereof alters translation of a gene (e.g. alters an amino acid sequence), inserts or deletes a start or stop codon, alters or fixes the translation frame of a gene. In some embodiments, an insertion, deletion, substitution, or combination thereof alters splicing of a gene, e.g. by inserting, deleting, or altering a splice acceptor or donor site. In some embodiments, an insertion, deletion, substitution, or combination thereof alters transcript or protein half-life. In some embodiments, an insertion, deletion, substitution, or combination thereof alters protein localization in the cell (e.g. from the cytoplasm to a mitochondria, from the cytoplasm into the extracellular space (e.g. adds a secretion tag)). In some embodiments, an insertion, deletion, substitution, or combination thereof alters (e.g. improves) protein folding (e.g. to prevent accumulation of misfolded proteins). In some embodiments, an insertion, deletion, substitution, or combination thereof, alters, increases, decreases the activity of a gene, e.g. a protein encoded by the gene.

Exemplary gene modifying polypeptides, and systems comprising them and methods of using them are described, e.g., in PCT/US2021/020948, which is incorporated herein by reference with respect to retroviral RT domains, including the amino acid and nucleic acid sequences therein.

Exemplary gene modifying polypeptides and retroviral RT domain sequences are also described, e.g., in International Application No. PCT/US21/20948 filed Mar. 4, 2021, e.g., at Table 30, Table 31, and Table 44 therein; the entire application is incorporated by reference herein with respect to retroviral RTs, e.g., in said sequences and tables. Accordingly, a gene modifying polypeptide described herein may comprise an amino acid sequence according to any of the Tables mentioned in this paragraph, or a domain thereof (e.g., a retroviral RT domain), or a functional fragment or variant of any of the foregoing, or an amino acid sequence having at least 70%, 80%, 85%, 90%, 95%, or 99% identity thereto.

In some embodiments, a polypeptide for use in any of the systems described herein can be a molecular reconstruction or ancestral reconstruction based upon the aligned polypeptide sequence of multiple homologous proteins. In some embodiments, a reverse transcriptase domain for use in any of the systems described herein can be a molecular reconstruction or an ancestral reconstruction, or can be modified at particular residues, based upon alignments of reverse transcriptase domains from the same or different sources. A skilled artisan can, based on the Accession numbers provided herein, align polypeptides or nucleic acid sequences, e.g., by using routine sequence analysis tools as Basic Local Alignment Search Tool (BLAST) or CD-Search for conserved domain analysis. Molecular reconstructions can be created based upon sequence consensus, e.g. using approaches described in Ivics et al., Cell 1997, 501-510; Wagstaff et al., Molecular Biology and Evolution 2013, 88-99.

Polypeptide Components of Gene Modifying Systems

In some embodiments, the gene modifying polypeptide possesses the functions of DNA target site binding, template nucleic acid (e.g., RNA) binding, DNA target site cleavage, and template nucleic acid (e.g., RNA) writing, e.g., reverse transcription. In some embodiments, each functions is contained within a distinct domain. In some embodiments, a function may be attributed to two or more domains (e.g., two or more domains, together, exhibit the functionality). In some embodiments, two or more domains may have the same or similar function (e.g., two or more domains each independently have DNA-binding functionality, e.g., for two different DNA sequences). In other embodiments, one or more domains may be capable of enabling one or more functions, e.g., a Cas9 domain enabling both DNA binding and target site cleavage. In some embodiments, the domains are all located within a single polypeptide. In some embodiments, a first domain is in one polypeptide and a second domain is in a second polypeptide. For example, in some embodiments, the sequences may be split between a first polypeptide and a second polypeptide, e.g., wherein the first polypeptide comprises a reverse transcriptase (RT) domain and wherein the second polypeptide comprises a DNA-binding domain and an endonuclease domain, e.g., a nickase domain. As a further example, in some embodiments, the first polypeptide and the second polypeptide each comprise a DNA binding domain (e.g., a first DNA binding domain and a second DNA binding domain). In some embodiments, the first and second polypeptide may be brought together post-translationally via a split-intein to form a single gene modifying polypeptide.

In some aspects, a gene modifying polypeptide described herein comprises (e.g., a system described herein comprises a gene modifying polypeptide that comprises): 1) a Cas domain (e.g., a Cas nickase domain, e.g., a Cas9 nickase domain); 2) a reverse transcriptase (RT) domain of Table D, or a sequence having at least 70%, 75%, 80%, 85%, 90%, 95%, 97%, 98%, or 99% identity thereto, wherein the RT domain is C-terminal of the Cas domain; and a linker disposed between the RT domain and the Cas domain, wherein the linker has a sequence from the same row of Table D as the RT domain, or a sequence having at least 70%, 75%, 80%, 85%, 90%, 95%, 97%, 98%, or 99% identity thereto.

In some embodiments, the RT domain has a sequence with 100% identity to the RT domain of Table D and the linker has a sequence with 100% identity to the linker sequence from the same row of Table D as the RT domain. In some embodiments, the Cas domain comprises a sequence of Table 8, or a sequence having at least 70%, 75%, 80%, 85%, 90%, 95%, 98%, or 99% identity thereto. In some embodiments, the gene modifying polypeptide comprises an amino acid sequence according to any of SEQ ID NOs: 1-3332 in the sequence listing, or a sequence having at least 70%, 75%, 80%, 85%, 90%, 95%, 97%, 98%, or 99% identity thereto.

In some embodiments, the gene modifying polypeptide comprises a GG amino acid sequence between the Cas domain and the linker, an AG amino acid sequence between the RT domain and the second NLS, and/or a GG amino acid sequence between the linker and the RT domain. In some embodiments, the gene modifying polypeptide comprises a sequence of SEQ ID NO: 4000 which comprises the first NLS and the Cas domain, or a sequence having at least 70%, 75%, 80%, 85%, 90%, 95%, 98%, or 99% identity thereto. In some embodiments, the gene modifying polypeptide comprises a sequence of SEQ ID NO: 4001 which comprises the second NLS, or a sequence having at least 70%, 75%, 80%, 85%, 90%, 95%, 98%, or 99% identity thereto.

```
Exemplary N-terminal NLS-Cas9 domain
                                                  (SEQ ID NO: 4000)
MPAAKRVKLDGGDKKYSIGLDIGTNSVGWAVITDEYKVPSKKFKVLGNTDRHSIKKNLIGALLF

DSGETAEATRLKRTARRRYTRRKNRICYLQEIFSNEMAKVDDSFFHRLEESFLVEEDKKHERHP
```

-continued

```
IFGNIVDEVAYHEKYPTIYHLRKKLVDSTDKADLRLIYLALAHMIKFRGHFLIEGDLNPDNSDV

DKLFIQLVQTYNQLFEENPINASGVDAKAILSARLSKSRRLENLIAQLPGEKKNGLFGNLIALS

LGLTPNFKSNFDLAEDAKLQLSKDTYDDDLDNLLAQIGDQYADLFLAAKNLSDAILLSDILRVN

TEITKAPLSASMIKRYDEHHQDLTLLKALVRQQLPEKYKEIFFDQSKNGYAGYIDGGASQEEFY

KFIKPILEKMDGTEELLVKLNREDLLRKIRTFDNGSIPHQIHLGELHAILRRQEDFYPFLKDNR

EKIEKILTFRIPYYVGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDLLFKTNRKVTVKQLK

EDYFKKIECFDSVEISGVEDRFNASLGTYHDLLKIIKDKDFLDNEENEDILEDIVLTLTLFEDR

EMIEERLKTYAHLFDDKVMKQLKRRRYTGWGRLSRKLINGIRDKQSGKTILDFLKSDGFANRNF

MQLIHDDSLTFKEDIQKAQVSGQGDSLHEHIANLAGSPAIKKGILQTVKVVDELVKVMGRHKPE

NIVIEMARENQTTQKGQKNSRERMKRIEEGIKELGSQILKEHPVENTQLQNEKLYLYYLINGRD

MYVDQELDINRLSDYDVDHIVPQSFLKDDSIDNKVLTRSDKARGKSDNVPSEEVVKKMKNYWRQ

LLNAKLITQRKFDNLTKAERGGLSELDKAGFIKRQLVETRIITKHVAQILDSRMNTKYDENDKL

IREVKVITLKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWDPKKYGGFDSPTVAY

SVLVVAKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKILFVEQHKHYLDEI

IEQISEFSKRVILADANLDKVLSAYNKHRDKPIREQAENIIHLFTLTNLGAPAAFKYFDTTIDR

KRYTSTKEVLDATLIHQSITGLYETRIDLSQLGGDGG
```

Exemplary C-terminal sequence comprising an NLS (SEQ ID NO: 4001)

```
AGKRTADGSEFEKRTADGSEFESPKKKAKVE
```

Writing Domain (RT Domain)

In certain aspects of the present invention, the writing domain of the gene modifying system possesses reverse transcriptase activity and is also referred to as a reverse transcriptase domain (a RT domain). In some embodiments, the RT domain comprises an RT catalytic portion and RNA-binding region (e.g., a region that binds the template RNA).

In some embodiments, a nucleic acid encoding the reverse transcriptase is altered from its natural sequence to have altered codon usage, e.g. improved for human cells. In some embodiments the reverse transcriptase domain is a heterologous reverse transcriptase from a retrovirus. In some embodiments, the RT domain comprising a gene modifying polypeptide has been mutated from its original amino acid sequence, e.g., has at least 1, 2, 3, 4, 5, 6, 7, 8, 9, 10, 20, 30, 40, 50, 60, 70, 80, 90, or 100 substitutions. In some embodiments, the RT domain is derived from the RT of a retrovirus, e.g., HIV-1 RT, Moloney Murine Leukemia Virus (MMLV) RT, avian myeloblastosis virus (AMV) RT, or Rous Sarcoma Virus (RSV) RT.

In some embodiments, the retroviral reverse transcriptase (RT) domain exhibits enhanced stringency of target-primed reverse transcription (TPRT) initiation, e.g., relative to an endogenous RT domain. In some embodiments, the RT domain initiates TPRT when the 3 nt in the target site immediately upstream of the first strand nick, e.g., the genomic DNA priming the RNA template, have at least 66% or 100% complementarity to the 3 nt of homology in the RNA template. In some embodiments, the RT domain initiates TPRT when there are less than 5 nt mismatched (e.g., less than 1, 2, 3, 4, or 5 nt mismatched) between the template RNA homology and the target DNA priming reverse transcription. In some embodiments, the RT domain is modified such that the stringency for mismatches in priming the TPRT reaction is increased, e.g., wherein the RT domain does not tolerate any mismatches or tolerates fewer mismatches in the priming region relative to a wild-type (e.g., unmodified) RT domain. In some embodiments, the RT domain comprises a HIV-1 RT domain. In embodiments, the HIV-1 RT domain initiates lower levels of synthesis even with three nucleotide mismatches relative to an alternative RT domain (e.g., as described by Jamburuthugoda and Eickbush J Mol Biol 407(5):661-672 (2011); incorporated herein by reference in its entirety). In some embodiments, the RT domain forms a dimer (e.g., a heterodimer or homodimer). In some embodiments, the RT domain is monomeric. In some embodiments, an RT domain, naturally functions as a monomer or as a dimer (e.g., heterodimer or homodimer). In some embodiments, an RT domain naturally functions as a monomer, e.g., is derived from a virus wherein it functions as a monomer. In embodiments, the RT domain is selected from an RT domain from murine leukemia virus (MLV; sometimes referred to as MoMLV) (e.g., P03355), porcine endogenous retrovirus (PERV) (e.g., UniProt Q4VFZ2), mouse mammary tumor virus (MMTV) (e.g., UniProt P03365), Avian reticuloendotheliosis virus (AVIRE) (e.g., UniProtKB accession: P03360); Feline leukemia virus (FLV or FeLV) (e.g., e.g., UniProtKB accession: P10273); Mason-Pfizer monkey virus (MPMV) (e.g., UniProt P07572), bovine leukemia virus (BLV) (e.g., UniProt P03361), human T-cell leukemia virus-1 (HTLV-1) (e.g., UniProt P03362), human foamy virus (HFV) (e.g., UniProt P14350), simian foamy virus (SFV) (e.g., SFV3L) (e.g., UniProt P23074 or P27401), or bovine foamy/syncytial virus (BFV/BSV) (e.g., UniProt O41894), or a functional fragment or variant thereof (e.g., an amino acid sequence having at least 70%, 80%, 90%, 95%, or 99% identity thereto). In some embodiments, an RT domain is dimeric in its natural functioning. In some embodiments, the RT domain is derived from a virus wherein it functions as a dimer. In embodiments, the RT domain is selected from an RT domain from avian sarcoma/leukemia virus (ASLV) (e.g., UniProt A0A142BKH1), Rous sarcoma virus (RSV) (e.g., UniProt P03354), avian myeloblastosis virus (AMV) (e.g., UniProt Q83133), human immunodeficiency virus type I (HIV-1) (e.g., UniProt P03369), human immunodeficiency virus type II (HIV-2) (e.g., UniProt P15833), simian immunodeficiency virus (SIV) (e.g., UniProt P05896), bovine immunodeficiency virus (BIV) (e.g., UniProt P19560), equine infectious anemia virus (EIAV) (e.g., UniProt P03371), or feline immunodeficiency virus (FIV) (e.g., UniProt P16088) (Herschhorn and Hizi *Cell Mol Life Sci* 67(16):2717-2747 (2010)), or a functional fragment or variant thereof (e.g., an amino acid sequence having at least 70%, 80%, 90%, 95%, or 99% identity thereto). Naturally heterodimeric RT domains may, in some embodiments, also be functional as homodimers. In some embodiments, dimeric RT domains are expressed as fusion proteins, e.g., as homodimeric fusion proteins or heterodimeric fusion proteins. In some embodiments, the RT function of the system is fulfilled by multiple RT domains (e.g., as described herein). In further embodiments, the multiple RT domains are fused or separate, e.g., may be on the same polypeptide or on different polypeptides.

In some embodiments, a gene modifying system described herein comprises an integrase domain, e.g., wherein the integrase domain may be part of the RT domain. In some embodiments, an RT domain (e.g., as described herein) comprises an integrase domain. In some embodiments, an RT domain (e.g., as described herein) lacks an integrase domain, or comprises an integrase domain that has been inactivated by mutation or deleted. In some embodiment, a gene modifying system described herein comprises an RNase H domain, e.g., wherein the RNase H domain may be part of the RT domain. In some embodiments, the RNase H domain is not part of the RT domain and is covalently linked via a flexible linker. In some embodiments, an RT domain (e.g., as described herein) comprises an RNase H domain, e.g., an endogenous RNAse H domain or a heterologous RNase H domain. In some embodiments, an RT domain (e.g., as described herein) lacks an RNase H domain. In some embodiments, an RT domain (e.g., as described herein) comprises an RNase H domain that has been added, deleted, mutated, or swapped for a heterologous RNase H domain. In some embodiments, the polypeptide comprises an inactivated endogenous RNase H domain. In some embodiments, an endogenous RNase H domain from one of the other domains of the polypeptide is genetically removed such that it is not included in the polypeptide, e.g., the endogenous RNase H domain is partially or completely truncated from the comprising domain. In some embodiments, mutation of an RNase H domain yields a polypeptide exhibiting lower RNase activity, e.g., as determined by the methods described in Kotewicz et al. *Nucleic Acids Res* 16(1):265-277 (1988) (incorporated herein by reference in its entirety), e.g., lower by at least 10%, 20%, 30%, 40%, 50%, 60%, 70%, 80%, or 90% compared to an otherwise similar domain without the mutation. In some embodiments, RNase H activity is abolished.

In some embodiments, an RT domain is mutated to increase fidelity compared to an otherwise similar domain without the mutation. For instance, in some embodiments, a YADD (SEQ ID NO: 37635) or YMDD motif (SEQ ID NO: 37636) in an RT domain (e.g., in a reverse transcriptase) is replaced with YVDD (SEQ ID NO: 37637). In embodiments, replacement of the YADD (SEQ ID NO: 37635) or YMDD (SEQ ID NO: 37636) or YVDD (SEQ ID NO: 37637) results in higher fidelity in retroviral reverse transcriptase activity (e.g., as described in Jamburuthugoda and Eickbush J Mol Biol 2011; incorporated herein by reference in its entirety).

In some embodiments, a gene modifying polypeptide described herein comprises an RT domain having an amino acid sequence according to Table 6, or a sequence having at least 70%, 80%, 85%, 90%, 95%, 97%, 98%, or 99% identity thereto. In some embodiments, a nucleic acid described herein encodes an RT domain having an amino acid sequence according to Table 6, or a sequence having at least 70%, 80%, 85%, 90%, 95%, 97%, 98%, or 99% identity thereto.

TABLE 6

Exemplary reverse transcriptase domains from retroviruses

| RT Name | SEQ ID NO: | RT amino acid sequence |
|---|---|---|
| AVIRE_ P03360 | 8,001 | TAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPV RKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFD EALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQV REFLGTIGYCRLWIPGFAELAQPLYAATRGGNDPLVWGEKEEEAFQSLKLALTQPPALALPSLDKPFQLFVEETSGAAKGVLTQALGPWKRPVAYLSK RLDPVAAGWPRCLRAIAAAALLTREASKLTFGQDIEITSSHNLESLLRSPPDKWLTNARITQYQVLLLDPPRVRFKQTAALNPATLLPETDDTLPIHHCLD TLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIY RERGLLTAGGKAIKNAPEILALLTAVWLPKRVAVMHCKGHQKDDAPTSTGNRRADEVAREVAIRPLSTQATIS |
| AVIRE_ P03360_ 3mut | 8,002 | TAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPV RKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFN EALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQV REFLGTIGYCRLWIPGFAELAQPLYAATRPGNDPLVWGEKEEEAFQSLKLALTQPPALALPSLDKPFQLFVEETSGAAKGVLTQALGPWKRPVAYLSK RLDPVAAGWPRCLRAIAAAALLTREASKLTFGQDIEITSSHNLESLLRSPPDKWLTNARITQYQVLLLDPPRVRFKQTAALNPATLLPETDDTLPIHHCLD TLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIY RERGWLTAGGKAIKNAPEILALLTAVWLPKRVAVMHCKGHQKDDAPTSTGNRRADEVAREVAIRPLSTQATIS |
| AVIRE_ P03360_ 3mutA | 8,003 | TAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPV RKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFN EALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQV REFLGKIGYCRLFIPGFAELAQPLYAATRPGNDPLVWGEKEEEAFQSLKLALTQPPALALPSLDKPFQLFVEETSGAAKGVLTQALGPWKRPVAYLSKR LDPVAAGWPRCLRAIAAAALLTREASKLTFGQDIEITSSHNLESLLRSPPDKWLTNARITQYQVLLLDPPRVRFKQTAALNPATLLPETDDTLPIHHCLDT LDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIY RERGWLTAGGKAIKNAPEILALLTAVWLPKRVAVMHCKGHQKDDAPTSTGNRRADEVAREVAIRPLSTQATIS |
| BAEVM_ P10272 | 8,004 | TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVK KPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFD EALHRDLTDFRTQHPEVTLLQYVDDLLLAAPTKKACTQGTRHLLQELGEKGYRASAKKAQICQTKVTYLGYILSEGKRWLTPGRIETVARIPPPRNPRE VREFLGTAGFCRLWIPGFAELAAPLYALTKESTPFTWQTEHQLAFEALKKALLSAPALGLPDTSKPFTLFLDERQGIAKGVLTQKLGPWKRPVAYLSKK LDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCR QVLAETHGTREDLKDQELPDADHTWYTDGSSYLDSGTRRAGAAVVDGHNTIWAQSLPPGTSAQKAELIALTKALELSKGKKANIYTDSRYAFATAHTH GSIYERRGLLTSEGKEIKNKAEIIALLKALFLPQEVAIIHCPGHQKGQDPVAVGNRQADRVARQAAMAEVLTLATEPDNTSHIT |
| BAEVM_ P10272_ 3mut | 8,005 | TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVK KPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFN EALHRDLTDFRTQHPEVTLLQYVDDLLLAAPTKKACTQGTRHLLQELGEKGYRASAKKAQICQTKVTYLGYILSEGKRWLTPGRIETVARIPPPRNPRE VREFLGTAGFCRLWIPGFAELAAPLYALTKPSTPFTWQTEHQLAFEALKKALLSAPALGLPDTSKPFTLFLDERQGIAKGVLTQKLGPWKRPVAYLSKK LDPVAAGWPPCLRIMAATAMLVKDSAKLTLGQPLTVITPHTLEAIVRQPPDRWITNARLTHYQALLLDTDRVQFGPPVTLNPATLLPVPENQPSPHDCR QVLAETHGTREDLKDQELPDADHTWYTDGSSYLDSGTRRAGAAVVDGHNTIWAQSLPPGTSAQKAELIALTKALELSKGKKANIYTDSRYAFATAHTH GSIYERRGWLTSEGKEIKNKAEIIALLKALFLPQEVAIIHCPGHQKGQDPVAVGNRQADRVARQAAMAEVLTLATEPDNTSHIT |

TABLE 6-continued

| Exemplary reverse transcriptase domains from retroviruses | | |
|---|---|---|
| RT Name | SEQ ID NO: | RT amino acid sequence |
| BAEVM_<br>P10272_<br>3mutA | 8,006 | TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVK<br>KPGTQDYRPVQDLREINKRTVDIHPTVPNPYNLLSTLKPDYSWYTVLDLKDAFFCLPLAPQSQELFAFEWKDPERGISGQLTWTRLPQGFKNSPTLFN<br>EALHRDLTDFRTQHPEVTLLQYVDDLLLAAPTKKACTQGTRHLLQELGEKGYRASAKKAQICQTKVTYLGYILSEGKRWLTPGRIETVARIPPPRNPRE<br>VREFLGKAGFCRLFIPGFAELAAPLYALTKPSTPFTWQTEHQLAFEALKKALLSAPALGLPDTSKPFTLFLDERQGIAKGVLTQKLGPWKRPVAYLSKKL<br>DPVAAGWPPCLRIMAATAMLVKDSAKLTLGQPLTVITPHTLEAIVRQPPDRWITNARLTHYQALLLDTDRVQFGPPVTLNPATLLPVPENQPSPHDCRQ<br>VLAETHGTREDLKDQELPDADHTWYTDGSSYLDSGTRRAGAAVVDGHNTIWAQSLPPGTSAQKAELIALTKALELSKGKKANIYTDSRYAFATAHTHG<br>SIYERRGWLTSEGKEIKNKAEIIALLKALFLPQEVAIIHCPGHQKGQDPVAVGNRQADRVARQAAMAEVLTLATEPDNTSHIT |
| BLVAU_<br>P25059 | 8,007 | GVLDAPPSHIGLEHLPPPPEVPQFPLNLERLQALQDLVHRSLEAGYISPWDGPGNNPVFPVRKPNGAWRFVHDLRVTNALTKPIPALSPGPPDLTAIPT<br>HLPHIICLDLKDAFFQIPVEDRFRSYFAFTLPTPGGLQPHRRFAWRVLPQGFINSPALFERALQEPLRQVSAAFSQSLLVSYMDDILYVSPTEEQRLQCY<br>QTMAAHLRDLGFQVASEKTRQTPSPVPFLGQMVHERMVTYQSLPTLQISSPISLHQLQTVLGDLQWVSRGTPTTRRPLQLLYSSLKGIDDPRAIIHLSP<br>EQQQGIAELRQALSHNARSRYNEQEPLLAYVHLTRAGSTLVLFQKGAQFPLAYFQTPLTDNQASPWGLLLLLGCQYLQAQALSSYAKTILKYYHNLPK<br>TSLDNWIQSSEDPRVQELLQLWPQISSQGIQPPGPWKTLVTRAEVFLTPQFSPEPIPAALCLFSDGAARRGAYCLWKDHLLDFQAVPAPESAQKGELA<br>GLLAGLAAAPPEPLNIWVDSKYLYSLLRTLVLGAWLQPDPVPSYALLYKSLLRHPAIFVGHVRSHSSASHPIASLNNYVDQL |
| BLVAU_<br>P25059_<br>2mut | 8,008 | GVLDAPPSHIGLEHLPPPPEVPQFPLNLERLQALQDLVHRSLEAGYISPWDGPGNNPVFPVRKPNGAWRFVHDLRVTNALTKPIPALSPGPPDLTAIPT<br>HLPHIICLDLKDAFFQIPVEDRFRSYFAFTLPTPGGLQPHRRFAWRVLPQGFINSPALFQRALQEPLRQVSAAFSQSLLVSYMDDILYVSPTEEQRLQCY<br>QTMAAHLRDLGFQVASEKTRQTPSPVPFLGQMVHERMVTYQSLPTLQISSPISLHQLQTVLGDLQWVSRGTPTTRRPLQLLYSSLKPIDDPRAIIHLSP<br>EQQQGIAELRQALSHNARSRYNEQEPLLAYVHLTRAGSTLVLFQKGAQFPLAYFQTPLTDNQASPWGLLLLLGCQYLQAQALSSYAKTILKYYHNLPK<br>TSLDNWIQSSEDPRVQELLQLWPQISSQGIQPPGPWKTLVTRAEVFLTPQFSPEPIPAALCLFSDGAARRGAYCLWKDHLLDFQAVPAPESAQKGELA<br>GLLAGLAAAPPEPLNIWVDSKYLYSLLRTLVLGAWLQPDPVPSYALLYKSLLRHPAIFVGHVRSHSSASHPIASLNNYVDQL |
| BLVJ_<br>P03361 | 8,009 | GVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPT<br>HPPHIICLDLKDAFFQIPVEDRFRFYLSFTLPSPGGLQPHRRFAWRVLPQGFINSPALFERALQEPLRQVSAAFSQSLLVSYMDDILYASPTEEQRSQCY<br>QALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPE<br>QLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTS<br>LDNWIQSSEDPRVQELLQLWPQISSQGIQPPGPWKTLITRAEVFLTPQFSPDPIPAALCLFSDGATGRGAYCLWKDHLLDFQAVPAPESAQKGELAGL<br>LAGLAAAPPEPVNIWVDSKYLYSLLRTLVLGAWLQPDPVPSYALLYKSLLRHPAIVVGHVRSHSSASHPIASLNNYVDQL |
| BLVJ_<br>P03361_<br>2mut | 8,010 | GVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPT<br>HPPHIICLDLKDAFFQIPVEDRFRFYLSFTLPSPGGLQPHRRFAWRVLPQGFINSPALFNRALQEPLRQVSAAFSQSLLVSYMDDILYASPTEEQRSQCY<br>QALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPE<br>QLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTS<br>LDNWIQSSEDPRVQELLQLWPQISSQGIQPPGPWKTLITRAEVFLTPQFSPDPIPAALCLFSDGATGRGAYCLWKDHLLDFQAVPAPESAQKGELAGL<br>LAGLAAAPPEPVNIWVDSKYLYSLLRTWVLGAWLQPDPVPSYALLYKSLLRHPAIVVGHVRSHSSASHPIASLNNYVDQL |
| BLVJ_<br>P03361_<br>2mutB | 8,011 | GVLDTPPSHIGLEHLPPPPEVPQFPLNLERLQALQDLVHRSLEAGYISPWDGPGNNPVFPVRKPNGAWRFVHDLRATNALTKPIPALSPGPPDLTAPP<br>THPPHIICLDLKDAFFQIPVEDRFRFYLSFTLPSPGGLQPHRRFAWRVLPQGFINSPALFQRALQEPLRQVSAAFSQSLLVSYMDDILYASPTEEQRSQC<br>YQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSP<br>EQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKT<br>SLDNWIQSSEDPRVQELLQLWPQISSQGIQPPGPWKTLITRAEVFLTPQFSPDPIPAALCLFSDGATGRGAYCLWKDHLLDFQAVPAPESAQKGELAG<br>LLAGLAAAPPEPVNIWVDSKYLYSLLRTWVLGAWLQPDPVPSYALLYKSLLRHPAIVVGHVRSHSSASHPIASLNNYVDQL |
| FFV_<br>O93209 | 8,012 | MDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLD<br>LEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPV<br>PKPNGRWRMVLDYRAVNKVTPLIAVQNQHSYGILGSLFKGRYKTTIDLSNGFWAHPIVPEDYWITAFTWQGKQYCWTVLPQGFLNSPGLFTGDVVDL<br>LQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPD<br>FTELIAPLYALIPKSTKNYVPWQIEHSTTLETLITKLNGAEYLQGRKGDKTLIMKVNASYTTGYIRYYNEGEKKPISYVSIVFSKTELKFTELEKLLTTVHKG |

TABLE 6-continued

| Exemplary reverse transcriptase domains from retroviruses | | |
|---|---|---|
| RT Name | SEQ ID NO: | RT amino acid sequence |
| | | LLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKE<br>GHLNAGMGIVYFINKDGNLQKQQEWSISLGNHTAQFAEIAAFEFALKKCLPLGGNILVVTDSNYVAKAYNEELDVWASNGFVNNRKKPLKHISKWKSV<br>ADLKRLRPDVVVTHEPGHQKLDSSPHAYGNNLADQLATQASFKVH |
| FFV_ O93209_ 2mut | 8,013 | MDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLD<br>LEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPV<br>PKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDL<br>LQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPD<br>FTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKG<br>LLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKE<br>GHLNAGMGIVYFINKDGNLQKQQEWSISLGNHTAQFAEIAAFEFALKKCLPLGGNILVVTDSNYVAKAYNEELDVWASNGFVNNRKKPLKHISKWKSV<br>ADLKRLRPDVVVTHEPGHQKLDSSPHAYGNNLADQLATQASFKVH |
| FFV_ O93209_ 2mutA | 8,014 | MDLLKPLTVERKGVKIKGYWNSQADITCVPKDLLQGEEPVRQQNVTTIHGTQEGDVYYVNLKIDGRRINTEVIGTTLDYAIITPGDVPWILKKPLELTIKLD<br>LEEQQGTLLNNSILSKKGKEELKQLFEKYSALWQSWENQVGHRRIRPHKIATGTVKPTPQKQYHINPKAKPDIQIVINDLLKQGVLIQKESTMNTPVYPV<br>PKPNGRWRMVLDYRAVNKVTPLIAVQNQHSYGILGSLFKGRYKTTIDLSNGFWAHPIVPEDYWITAFTWQGKQYCWTVLPQGFLNSPGLFNGDVVDL<br>LQGIPNVEVYVDDVYISHDSEKEHLEYLDILFNRLKEAGYIISLKKSNIANSIVDFLGFQITNEGRGLTDTFKEKLENITAPTTLKQLQSILGKLNFARNFIPD<br>FTELIAPLYALIPKSPKNYVPWQIEHSTTLETLITKLNGAEYLQGRKGDKTLIMKVNASYTTGYIRYYNEGEKKPISYVSIVFSKTELKFTELEKLLTTVHKG<br>LLKALDLSMGQNIHVYSPIVSMQNIQKTPQTAKKALASRWLSWLSYLEDPRIRFFYDPQMPALKDLPAVDTGKDNKKHPSNFQHIFYTDGSAITSPTKE<br>GHLNAGMGIVYFINKDGNLQKQQEWSISLGNHTAQFAEIAAFEFALKKCLPLGGNILVVTDSNYVAKAYNEELDVWASNGFVNNRKKPLKHISKWKSV<br>ADLKRLRPDVVVTHEPGHQKLDSSPHAYGNNLADQLATQASFKVH |
| FFV_ O93209- Pro | 8,015 | VPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGV<br>LIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGF<br>LNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQ<br>SILGLLNFARNFIPDFTELIAPLYALIPKSTKNYVPWQIEHSTTLETLITKLNGAEYLQGRKGDKTLIMKVNASYTTGYIRYYNEGEKKPISYVSIVFSKTELK<br>FTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHI<br>FYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNR<br>KKPLKHISKWKSVADLKRLRPDVVVTHEPGHQKLDSSPHAYGNNLADQLATQASFKVH |
| FFV_ O93209- Pro_2mut | 8,016 | VPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGV<br>LIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGF<br>LNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQ<br>SILGLLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELK<br>FTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHI<br>FYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNR<br>KKPLKHISKWKSVADLKRLRPDVVVTHEPGHQKLDSSPHAYGNNLADQLATQASFKVH |
| FFV_ O93209- Pro_2mutA | 8,017 | VPWILKKPLELTIKLDLEEQQGTLLNNSILSKKGKEELKQLFEKYSALWQSWENQVGHRRIRPHKIATGTVKPTPQKQYHINPKAKPDIQIVINDLLKQGV<br>LIQKESTMNTPVYPVPKPNGRWRMVLDYRAVNKVTPLIAVQNQHSYGILGSLFKGRYKTTIDLSNGFWAHPIVPEDYWITAFTWQGKQYCWTVLPQGF<br>LNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQ<br>SILGKLNFARNFIPDFTELIAPLYALIPKSPKNYVPWQIEHSTTLETLITKLNGAEYLQGRKGDKTLIMKVNASYTTGYIRYYNEGEKKPISYVSIVFSKTELK<br>FTELEKLLTTVHKGLLKALDLSMGQNIHVYSPIVSMQNIQKTPQTAKKALASRWLSWLSYLEDPRIRFFYDPQMPALKDLPAVDTGKDNKKHPSNFQHI<br>FYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNR<br>KKPLKHISKWKSVADLKRLRPDVVVTHEPGHQKLDSSPHAYGNNLADQLATQASFKVH |
| FLV_ P10273 | 8,018 | TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLP<br>VKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTL |

TABLE 6-continued

Exemplary reverse transcriptase domains from retroviruses

| RT Name | SEQ ID NO: | RT amino acid sequence |
|---|---|---|
| | | FDEALHSDLADFRVRYPALVLLQYVDDLLLAAATRTECLEGTKALLETLGNKGYRASAKKAQICLQEVTYLGYSLKDGQRWLTKARKEAILSIPVPKNSR<br>QVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSK<br>KLDTVASGWPPCLRMVAAIAILVKDAGKLTLGQPLTILTSHPVEALVRQPPNKWLSNARMTHYQAMLLDAERVHFGPTVSLNPATLLPLPSGGNHHDC<br>LQILAETHGTRPDLTDQPLPDADLTWYTDGSSFIRNGEREAGAAVTTESEVIWAAPLPPGTSAQRAELIALTQALKMAEGKKLTVYTDSRYAFATTHVH<br>GEIYRRRGLLTSEGKEIKNKNEILALLEALFLPKRLSIIHCPGHQKGDSPQAKGNRLADDTAKKAATETHSSLTVLP |
| FLV_<br>P10273_<br>3mut | 8,019 | TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLP<br>VKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTL<br>FNEALHSDLADFRVRYPALVLLQYVDDLLLAAATRTECLEGTKALLETLGNKGYRASAKKAQICLQEVTYLGYSLKDGQRWLTKARKEAILSIPVPKNSR<br>QVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSK<br>KLDTVASGWPPCLRMVAAIAILVKDAGKLTLGQPLTILTSHPVEALVRQPPNKWLSNARMTHYQAMLLDAERVHFGPTVSLNPATLLPLPSGGNHHDC<br>LQILAETHGTRPDLTDQPLPDADLTWYTDGSSFIRNGEREAGAAVTTESEVIWAAPLPPGTSAQRAELIALTQALKMAEGKKLTVYTDSRYAFATTHVH<br>GEIYRRRGWLTSEGKEIKNKNEILALLEALFLPKRLSIIHCPGHQKGDSPQAKGNRLADDTAKKAATETHSSLTVLP |
| FLV_<br>P10273_<br>3mutA | 8,020 | TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLP<br>VKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTL<br>FNEALHSDLADFRVRYPALVLLQYVDDLLLAAATRTECLEGTKALLETLGNKGYRASAKKAQICLQEVTYLGYSLKDGQRWLTKARKEAILSIPVPKNSR<br>QVREFLGKAGYCRLFIPGFAELAAPLYPLTRPGTLFQWGTEQQLAFEDIKKALLSSPALGLPDITKPFELFIDENSGFAKGVLVQKLGPWKRPVAYLSKK<br>LDTVASGWPPCLRMVAAIAILVKDAGKLTLGQPLTILTSHPVEALVRQPPNKWLSNARMTHYQAMLLDAERVHFGPTVSLNPATLLPLPSGGNHHDCL<br>QILAETHGTRPDLTDQPLPDADLTWYTDGSSFIRNGEREAGAAVTTESEVIWAAPLPPGTSAQRAELIALTQALKMAEGKKLTVYTDSRYAFATTHVHG<br>EIYRRRGWLTSEGKEIKNKNEILALLEALFLPKRLSIIHCPGHQKGDSPQAKGNRLADDTAKKAATETHSSLTVLP |
| FOAMV_<br>P14350 | 8,021 | MNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTIL<br>VPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPV<br>YPVPKPDGRWRMVLDYREVNKTIPLTAAQNQHSAGILATIVRQKYKTTLDLANGFWAHPITPESYWLTAFTWQGKQYCWTRLPQGFLNSPALFTADV<br>VDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFAR<br>NFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKL<br>LTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAI<br>KSPDPTKSNNAGMGIVHATYKPEYQVLNQWSIPLGNHTAQMAEIAAVEFACKKALKIPGPVLVITDSFYVAESANKELPYWKSNGFVNNKKKPLKHISK<br>WKSIAECLSMKPDITIQHEKGISLQIPVFILKGNALADKLATQGSYVVN |
| FOAMV_<br>P14350_<br>2mut | 8,022 | MNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTIL<br>VPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPV<br>YPVPKPDGRWRMVLDYREVNKTIPLTAAQNQHSAGILATIVRQKYKTTLDLANGFWAHPITPESYWLTAFTWQGKQYCWTRLPQGFLNSPALFNADV<br>VDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFAR<br>NFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKL<br>LTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAI<br>KSPDPTKSNNAGMGIVHATYKPEYQVLNQWSIPLGNHTAQMAEIAAVEFACKKALKIPGPVLVITDSFYVAESANKELPYWKSNGFVNNKKKPLKHISK<br>WKSIAECLSMKPDITIQHEKGISLQIPVFILKGNALADKLATQGSYVVN |
| FOAMV_<br>P14350_<br>2mutA | 8,023 | MNPLQLLQPLPAEIKGTKLLAHWNSGATITCIPESFLEDEQPIKKTLIKTIHGEKQQNVYYVTFKVKGRKVEAEVIASPYEYILLSPTDVPWLTQQPLQLTIL<br>VPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPV<br>YPVPKPDGRWRMVLDYREVNKTIPLTAAQNQHSAGILATIVRQKYKTTLDLANGFWAHPITPESYWLTAFTWQGKQYCWTRLPQGFLNSPALFNADV<br>VDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGKLNFAR<br>NFIPNFAELVQPLYNLIAPAKGKYIEWSEENTKQLNMVIEALNTASNLEERLPEQRLVIKVNTSPSAGYVRYYNETGKKPIMYLNYVFSKAELKFSMLEKL<br>LTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAI<br>KSPDPTKSNNAGMGIVHATYKPEYQVLNQWSIPLGNHTAQMAEIAAVEFACKKALKIPGPVLVITDSFYVAESANKELPYWKSNGFVNNKKKPLKHISK<br>WKSIAECLSMKPDITIQHEKGISLQIPVFILKGNALADKLATQGSYVVN |

TABLE 6-continued

| Exemplary reverse transcriptase domains from retroviruses | | |
|---|---|---|
| RT Name | SEQ ID NO: | RT amino acid sequence |
| FOAMV_ P14350- Pro | 8,024 | VPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQG<br>VLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQ<br>GFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLK<br>QLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVF<br>SKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPS<br>QYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGF<br>VNNKKKPLKHISKWKSIAECLSMKPDITIQHEKGISLQIPVFILKGNALADKLATQGSYVVN |
| FOAMV_ P14350- Pro_2mut | 8,025 | VPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQG<br>VLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQ<br>GFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDL<br>KQLQSILGLLNFARNFIPNFAELVQPLYNLIAPAKGKYIEWSEENTKQLNMVIEALNTASNLEERLPEQRLVIKVNTSPSAGYVRYYNETGKKPIMYLNYV<br>FSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHP<br>SQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNG<br>FVNNKKKPLKHISKWKSIAECLSMKPDITIQHEKGISLQIPVFILKGNALADKLATQGSYVVN |
| FOAMV_ P14350- Pro_2mutA | 8,026 | VPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQG<br>VLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQ<br>GFLNSPALFNADVVDLLKEIPNVQVYVDDIYLSHDDPKEHVQQLEKVFQILLQAGYVVSLKKSEIGQKTVEFLGFNITKEGRGLTDTFKTKLLNITPPKDL<br>KQLQSILGKLNFARNFIPNFAELVQPLYNLIAPAKGKYIEWSEENTKQLNMVIEALNTASNLEERLPEQRLVIKVNTSPSAGYVRYYNETGKKPIMYLNYV<br>FSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHP<br>SQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNG<br>FVNNKKKPLKHISKWKSIAECLSMKPDITIQHEKGISLQIPVFILKGNALADKLATQGSYVVN |
| GALV_ P21414 | 8,027 | VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLL<br>PVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSP<br>TLFDEALHRDLAPFRALNPQVVLLQYVDDLLVAAPTYEDCKKGTQKLLQELSKLGYRVSAKKAQLCQREVTYLGYLLKEGKRWLTPARKATVMKIPVP<br>TTPRQVREFLGTAGFCRLWIPGFASLAAPLYPLTKESIPFIWTEEHQQAFDHIKKALLSAPALALPDLTKPFTLYIDERAGVARGVLTQTLGPWRRPVAY<br>LSKKLDPVASGWPTCLKAVAAVALLLKDADKLTLGQNVTVIASHSLESIVRQPPDRWMTNARMTHYQSLLLNERVSFAPPAVLNPATLLPVESEATPVH<br>RCSEILAEETGTRRDLEDQPLPGVPTWYTDGSSFITEGKRRAGAPIVDGKRTVWASSLPEGTSAQKAELVALTQALRLAEGKNINIYTDSRYAFATAHIH<br>GAIYKQRGLLTSAGKDIKNKEEILALLEAIHLPRRVAIIHCPGHQRGSNPVATGNRRADEAAKQAALSTRVLAGTTKP |
| GALV_ P21414_ 3mut | 8,028 | VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLL<br>PVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSP<br>TLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVP<br>TTPRQVREFLGTAGFCRLWIPGFASLAAPLYPLTKPSIPFIWTEEHQQAFDHIKKALLSAPALALPDLTKPFTLYIDERAGVARGVLTQTLGPWRRPVAY<br>LSKKLDPVASGWPTCLKAVAAVALLLKDADKLTLGQNVTVIASHSLESIVRQPPDRWMTNARMTHYQSLLLNERVSFAPPAVLNPATLLPVESEATPVH<br>RCSEILAEETGTRRDLEDQPLPGVPTWYTDGSSFITEGKRRAGAPIVDGKRTVWASSLPEGTSAQKAELVALTQALRLAEGKNINIYTDSRYAFATAHIH<br>GAIYKQRGWLTSAGKDIKNKEEILALLEAIHLPRRVAIIHCPGHQRGSNPVATGNRRADEAAKQAALSTRVLAGTTKP |
| GALV_ P21414_ 3mutA | 8,029 | VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLL<br>PVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSP<br>TLFNEALHRDLAPFRALNPQVVLLQYVDDLLVAAPTYEDCKKGTQKLLQELSKLGYRVSAKKAQLCQREVTYLGYLLKEGKRWLTPARKATVMKIPVP<br>TTPRQVREFLGKAGFCRLFIPGFASLAAPLYPLTKPSIPFIWTEEHQQAFDHIKKALLSAPALALPDLTKPFTLYIDERAGVARGVLTQTLGPWRRPVAYL<br>SKKLDPVASGWPTCLKAVAAVALLLKDADKLTLGQNVTVIASHSLESIVRQPPDRWMTNARMTHYQSLLLNERVSFAPPAVLNPATLLPVESEATPVH<br>RCSEILAEETGTRRDLEDQPLPGVPTWYTDGSSFITEGKRRAGAPIVDGKRTVWASSLPEGTSAQKAELVALTQALRLAEGKNINIYTDSRYAFATAHIH<br>GAIYKQRGWLTSAGKDIKNKEEILALLEAIHLPRRVAIIHCPGHQRGSNPVATGNRRADEAAKQAALSTRVLAGTTKP |

TABLE 6-continued

Exemplary reverse transcriptase domains from retroviruses

| RT Name | SEQ ID NO: | RT amino acid sequence |
|---|---|---|
| HTL1A_ P03362 | 8,030 | AVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTI DLRDAFFQIPLPKQFQPYFAFTVPQQCNYGPGTRYAWKVLPQGFKNSPTLFEMQLAHILQPIRQAFPQCTILQYMDDILLASPSHEDLLLLSEATMASLI SHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQL RQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTS DHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLL HGLSSARSWRCLNIFLDSKYLYHYLRTLALGTFQGRSSQAPFQALLPRLLSRKVVYLHHVRSHTNLPDPISRLNALTDALLITPVLQL |
| HTL1A_ P03362_ 2mut | 8,031 | AVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTI DLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLI SHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQL RQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTS DHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLL HGLSSARSWRCLNIFLDSKYLYHYLRTLALGTFQGRSSQAPFQALLPRLLSRKVVYLHHVRSHTNLPDPISRLNALTDALLITPVLQL |
| HTL1A_ P03362_ 2mutB | 8,032 | AVLGLEHLPRPPQISQFPLNPERLQALQHLVRKALEAGHIEPYTGPGNNPVFPVKKANGTWRFIHDLRATNSLTIDLSSSSPGPPDLSSPPTTLAHLQTI DLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLI SHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQL RQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTS DHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLL HGLSSARSWRCLNIFLDSKYLYHYLRTLALGTFQGRSSQAPFQALLPRLLSRKVVYLHHVRSHTNLPDPISRLNALTDALLITPVLQL |
| HTL1C_ P14078 | 8,033 | AVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTI DLKDAFFQIPLPKQFQPYFAFTVPQQCNYGPGTRYAWRVLPQGFKNSPTLFEMQLAHILQPIRQAFPQCTILQYMDDILLASPSHADLQLLSEATMASLI SHGLPVSENKTQQTPGTIKFLGQIISPNHLTYDAVPKVPIRSRWALPELQALLGEIQWVSKGTPTLRQPLHSLYCALQRHTDPRDQIYLNPSQVQSLVQL RQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTS DHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLL HGLSSARSWRCLNIFLDSKYLYHYLRTLALGTFQGRSSQAPFQALLPRLLSRKVVYLHHVRSHTNLPDPISRLNALTDALLITPVLQL |
| HTL1C_ P14078_ 2mut | 8,034 | AVLGLEHLPRPPEISQFPLNPERLQALQHLVRKALEAGHIEPYTGPGNNPVFPVKKANGTWRFIHDLRATNSLTIDLSSSSPGPPDLSSLPTTLAHLQTI DLKDAFFQIPLPKQFQPYFAFTVPQQCNYGPGTRYAWRVLPQGFKNSPTLFQMQLAHILQPIRQAFPQCTILQYMDDILLASPSHADLQLLSEATMASLI SHGLPVSENKTQQTPGTIKFLGQIISPNHLTYDAVPKVPIRSRWALPELQALLGEIQWVSKGTPTLRQPLHSLYCALQPHTDPRDQIYLNPSQVQSLVQL RQALSQNCRSRLVQTLPLLGAIMLTLTGTTTVVFQSKQQWPLVWLHAPLPHTSQCPWGQLLASAVLLLDKYTLQSYGLLCQTIHHNISTQTFNQFIQTS DHPSVPILLHHSHRFKNLGAQTGELWNTFLKTTAPLAPVKALMPVFTLSPVIINTAPCLFSDGSTSQAAYILWDKHILSQRSFPLPPPHKSAQRAELLGLL HGLSSARSWRCLNIFLDSKYLYHYLRTLALGTFQGRSSQAPFQALLPRLLSRKVVYLHHVRSHTNLPDPISRLNALTDALLITPVLQL |
| HTL1L_ P0C211 | 8,035 | GLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLK DAFFQIPLPKQFQPYFAFTVPQQCNYGPGTRYAWKVLPQGFKNSPTLFEMQLASILQPIRQAFPQCVILQYMDDILLASPSPEDLQQLSEATMASLISH GLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQ QALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSD HPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLH GLSSARSWHCLNIFLDSKYLYHYLRTLALGTFQGKSSQAPFQALLPRLLAHKVIYLHHVRSHTNLPDPISKLNALTDALLITPIL |

TABLE 6-continued

| Exemplary reverse transcriptase domains from retroviruses | | |
|---|---|---|
| RT Name | SEQ ID NO: | RT amino acid sequence |
| HTL1L_ P0C211_ 2mut | 8,036 | GLEHLPRPPEISQFPLNPERLQALQHLVRKALEAGHIEPYTGPGNNPVFPVKKANGTWRFIHDLRATNSLTVDLSSSSPGPPDLSSLPTTLAHLQTIDLK<br>DAFFQIPLPKQFQPYFAFTVPQQCNYGPGTRYAWKVLPQGFKNSPTLFQMQLASILQPIRQAFPQCVILQYMDDILLASPSPEDLQQLSEATMASLISH<br>GLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQ<br>QALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSD<br>HPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLH<br>GLSSARSWHCLNIFLDSKYLYHYLRTLAWGTFQGKSSQAPFQALLPRLLAHKVIYLHHVRSHTNLPDPISKLNALTDALLITPIL |
| HTL1L_ P0C211_ 2mutB | 8,037 | GLEHLPRPPEISQFPLNPERLQALQHLVRKALEAGHIEPYTGPGNNPVFPVKKANGTWRFIHDLRATNSLTVDLSSSSPGPPDLSSPPTTLAHLQTIDLK<br>DAFFQIPLPKQFQPYFAFTVPQQCNYGPGTRYAWKVLPQGFKNSPTLFQMQLASILQPIRQAFPQCVILQYMDDILLASPSPEDLQQLSEATMASLISH<br>GLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQ<br>QALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSD<br>HPSVPILLHHSHRFKNLGAQTGELWNTFLKTAAPLAPVKALTPVFTLSPIIINTAPCLFSDGSTSQAAYILWDKHILSQRSFPLPPPHKSAQQAELLGLLH<br>GLSSARSWHCLNIFLDSKYLYHYLRTLAWGTFQGKSSQAPFQALLPRLLAHKVIYLHHVRSHTNLPDPISKLNALTDALLITPIL |
| HTL32_ Q0R5R2 | 8,038 | GLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLT<br>DAFFQIPLPTIFQPYFAFTLPQPNNYGPGTRYSWRVLPQGFKNSPTLFEQQLSHILTPVRKTFPNSLIIQYMDDILLASPAPGELAALTDKVTNALTKEGL<br>PLSPEKTQATPGPIHFLGQVISQDCITYETLPSINVKSTWSLAELQSMLGELQWVSKGTPVLRSSLHQLYLALRGHRDPRDTIKLTSIQVQALRTIQKALT<br>LNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSV<br>AILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQK<br>SQPWVALNIFLDSKFLIGHLRRMALGAFPGPSTQCELHTQLLPLLQGKTVYVHHVRSHTLLQDPISRLNEATDALMLAPLLPL |
| HTL32_ Q0R5R2_ 2mut | 8,039 | GLEHLPPPPEVSQFPLNPERLQALTDLVSRALEAKHIEPYQGPGNNPIFPVKKPNGKWRFIHDLRATNSVTRDLASPSPGPPDLTSLPQGLPHLRTIDLT<br>DAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEGL<br>PLSPEKTQATPGPIHFLGQVISQDCITYETLPSINVKSTWSLAELQSMLGELQWVSKGTPVLRSSLHQLYLALRGHRDPRDTIKLTSIQVQALRTIQKALT<br>LNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSV<br>AILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQK<br>SQPWVALNIFLDSKFLIGHLRRMAWGAFPGPSTQCELHTQLLPLLQGKTVYVHHVRSHTLLQDPISRLNEATDALMLAPLLPL |
| HTL32_ Q0R5R2_ 2mutB | 8,040 | GLEHLPPPPEVSQFPLNPERLQALTDLVSRALEAKHIEPYQGPGNNPIFPVKKPNGKWRFIHDLRATNSVTRDLASPSPGPPDLTSPPQGLPHLRTIDL<br>TDAFFQIPLPTIFQPYFAFTLPQPNNYGPGTRYSWRVLPQGFKNSPTLFQQQLSHILTPVRKTFPNSLIIQYMDDILLASPAPGELAALTDKVTNALTKEG<br>LPLSPEKTQATPGPIHFLGQVISQDCITYETLPSINVKSTWSLAELQSMLGELQWVSKGTPVLRSSLHQLYLALRGHRDPRDTIKLTSIQVQALRTIQKAL<br>TLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSS<br>VAILLQHSHRFHNLGAQPSGPWRSLLQMPQIFQNIDVLRPPFTISPVVINHAPCLFSDGSASKAAFIIWDRQVIHQQVLSLPSTCSAQAGELFGLLAGLQ<br>KSQPWVALNIFLDSKFLIGHLRRMAWGAFPGPSTQCELHTQLLPLLQGKTVYVHHVRSHTLLQDPISRLNEATDALMLAPLLPL |
| HTL3P_ Q4U0X6 | 8,041 | GLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLT<br>DAFFQIPLPAVFQPYFAFTLPQPNNHGPGTRYSWRVLPQGFKNSPTLFEQQLSHILAPVRKAFPNSLIIQYMDDILLASPALRELTALTDKVTNALTKEGL<br>PMSLEKTQATPGSIHFLGQVISPDCITYETLPSIHVKSIWSLAELQSMLGELQWVSKGTPVLRSSLHQLYLALRGHRDPRDTIELTSTQVQALKTIQKALA<br>LNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAIL<br>LQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSKP<br>WPALNIFLDSKFLIGHLRRMALGAFLGPSTQCDLHARLFPLLQGKTVYVHHVRSHTLLQDPISRLNEATDALMLAPLLPL |
| HTL3P_ Q4U0X6_ 2mut | 8,042 | GLEHLPPPPEVSQFPLNPERLQALTDLVSRALEAKHIEPYQGPGNNPIFPVKKPNGKWRFIHDLRATNSLTRDLASPSPGPPDLTSLPQDLPHLRTIDLT<br>DAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEG<br>LPMSLEKTQATPGSIHFLGQVISPDCITYETLPSIHVKSIWSLAELQSMLGELQWVSKGTPVLRSSLHQLYLALRGHRDPRDTIELTSTQVQALKTIQKAL<br>ALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAI<br>LLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSK<br>PWPALNIFLDSKFLIGHLRRMAWGAFLGPSTQCDLHARLFPLLQGKTVYVHHVRSHTLLQDPISRLNEATDALMLAPLLPL |

TABLE 6-continued

| Exemplary reverse transcriptase domains from retroviruses | | |
|---|---|---|
| RT Name | SEQ ID NO: | RT amino acid sequence |
| HTL3P_ Q4U0X6_ 2mutB | 8,043 | GLEHLPPPPEVSQFPLNPERLQALTDLVSRALEAKHIEPYQGPGNNPIFPVKKPNGKWRFIHDLRATNSLTRDLASPSPGPPDLTSPPQDLPHLRTIDLT<br>DAFFQIPLPAVFQPYFAFTLPQPNNHGPGTRYSWRVLPQGFKNSPTLFQQQLSHILAPVRKAFPNSLIIQYMDDILLASPALRELTALTDKVTNALTKEG<br>LPMSLEKTQATPGSIHFLGQVISPDCITYETLPSIHVKSIWSLAELQSMLGELQWVSKGTPVLRSSLHQLYLALRGHRDPRDTIELTSTQVQALKTIQKAL<br>ALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAI<br>LLQHSHRFHNLGAQPSGPWRSLLQVPQIFQNIDVLRPPFIISPVVIDHAPCLFSDGATSKAAFILWDKQVIHQQVLPLPSTCSAQAGELFGLLAGLQKSK<br>PWPALNIFLDSKFLIGHLRRMAWGAFLGPSTQCDLHARLFPLLQGKTVYVHHVRSHTLLQDPISRLNEATDALMLAPLLPL |
| HTLV2_ P03363_ 2mut | 8,044 | HLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDA<br>FFQIPLPKQYQPYFAFTIPQPCNYGPGTRYAWTVLPQGFKNSPTLFQQQLAAVLNPMRKMFPTSTIVQYMDDILLASPTNEELQQLSQLTLQALTTHGL<br>PISQEKTQQTPGQIRFLGQVISPNHITYESTPTIPIKSQWTLTELQVILGEIQWVSKGTPILRKHLQSLYSALHPYRDPRACITLTPQQLHALHAIQQALQH<br>NCRGRLNPALPLLGLISLSTSGTTSVIFQPKQNWPLAWLHTPHPPTSLCPWGHLLACTILTLDKYTLQHYGQLCQSFHHNMSKQALCDFLRNSPHPSV<br>GILIHHMGRFHNLGSQPSGPWKTLLHLPTLLQEPRLLRPIFTLSPVVLDTAPCLFSDGSPQKAAYVLWDQTILQQDITPLPSHETHSAQKGELLALICGLR<br>AAKPWPSLNIFLDSKYLIKYLHSLAIGAFLGTSAHQTLQAALPPLLQGKTIYLHHVRSHTNLPDPISTFNEYTDSLILAPLVPL |
| JSRV_ P31623 | 8,045 | PLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPT<br>PSAIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLL<br>YQAFSILKQHLSLNGLVIADEKIQTHFPYNYLGFSLYPRVYNTQLVKLQTDHLKTLNDFQKLLGDINWIRPYLKLPTYTLQPLFDILKGDSDPASPRTLSLE<br>GRTALQSIEEAIRQQQITYCDYQRSWGLYILPTPRAPTGVLYQDKPLRWIYLSATPTKHLLPYYELVAKIIAKGRHEAIQYFGMEPPFICVPYALEQQDWL<br>FQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNL<br>FTDSSYVVGALQMIETVPIIGTTSPEVLNLFTLIQQVLHCRQHPCFFGHIRAHSTLPGALVQGNHTADVLTKQVFFQS |
| JSRV_ P31623_ 2mutB | 8,046 | PLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPT<br>PSPIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLL<br>YQAFSILKQHLSLNGLVIADEKIQTHFPYNYLGFSLYPRVYNTQLVKLQTDHLKTLNDFQKLLGDINWIRPYLKLPTYTLQPLFDILKGDSDPASPRTLSLE<br>GRTALQSIEEAIRQQQITYCDYQRSWGLYILPTPRAPTGVLYQDKPLRWIYLSATPTKHLLPYYELVAKIIAKGRHEAIQYFGMEPPFICVPYALEQQDWL<br>FQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNL<br>FTDSSYVVGALQMIETVPIIGTTSPEVLNLFTLIQQVLHCRQHPCFFGHIRAHSTLPGALVQGNHTADVLTKQVFFQS |
| KORV_ Q9TTC1 | 8,047 | TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLT<br>KLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGI<br>RPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEW<br>RDPEKGNTGQLTWTRLPQGFKNSPTLFDEALHRDLASFRALNPQVVMLQYVDDLLVAAPTYRDCKEGTRRLLQELSKLGYRVSAKKAQLCREEVTYL<br>GYLLKGGKRWLTPARKATVMKIPTPTTPRQVREFLGTAGFCRLWIPGFASLAAPLYPLTREKVPFTWTEAHQEAFGRIKEALLSAPALALPDLTKPFAL<br>YVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLN<br>ERVSFAPPAILNPATLLPVESDDTPIHICSEILAEETGTRPDLRDQPLPGVPAWYTDGSSFIMDGRRQAGAAIVDNKRTVWASNLPEGTSAQKAELIALT<br>QALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTET<br>TKN |
| KORV_ Q9TTC1_ 3mut | 8,048 | TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLT<br>KLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGI<br>RPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEW<br>RDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYL<br>GYLLKGGKRWLTPARKATVMKIPTPTTPRQVREFLGTAGFCRLWIPGFASLAAPLYPLTRPKVPFTWTEAHQEAFGRIKEALLSAPALALPDLTKPFAL<br>YVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLN<br>ERVSFAPPAILNPATLLPVESDDTPIHICSEILAEETGTRPDLRDQPLPGVPAWYTDGSSFIMDGRRQAGAAIVDNKRTVWASNLPEGTSAQKAELIALT<br>QALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTE<br>TTKN |

TABLE 6-continued

| Exemplary reverse transcriptase domains from retroviruses | | |
|---|---|---|
| RT Name | SEQ ID NO: | RT amino acid sequence |
| KORV_ Q9TTC1_ 3mutA | 8,049 | TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLT KLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGI RPHIQRFLDLGILVPCQSPWNTPLLPVKKPGTNDYRPVQDLREVNKRVQDIHPTVPNPYNLLSSLPPSHTWYSVLDLKDAFFCLKLHPNSQPLFAFEW RDPEKGNTGQLTWTRLPQGFKNSPTLFNEALHRDLASFRALNPQVVMLQYVDDLLVAAPTYRDCKEGTRRLLQELSKLGYRVSAKKAQLCREEVTYL GYLLKGGKRWLTPARKATVMKIPTPTTPRQVREFLGKAGFCRLFIPGFASLAAPLYPLTRPKVPFTWTEAHQEAFGRIKEALLSAPALALPDLTKPFALY VDEKEGVARGVLTQTLGPWRRPVAYLSKKLDPVASGWPTCLKAIAAVALLLKDADKLTLGQNVLVIAPHNLESIVRQPPDRWMTNARMTHYQSLLLNE RVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQ ALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTET TKN |
| KORV_ Q9TTC1- Pro | 8,050 | LLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPM SKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQ PLFAFEWRDPEKGNTGQLTWTRLPQGFKNSPTLFDEALHRDLASFRALNPQWVMLQYVDDLLVAAPTYRDCKEGTRRLLQELSKLGYRVSAKKAQLC REEVTYLGYLLKGGKRWLTPARKATVMKIPTPTTPRQVREFLGTAGFCRLWIPGFASLAAPLYPLTREKVPFTWTEAHQEAFGRIKEALLSAPALALPD LTKPFALYVDEKEGVARGVLTQTLGPWRRPVAYLSKKLDPVASGWPTCLKAIAAVALLLKDADKLTLGQNVLVIAPHNLESIVRQPPDRWMTNARMTH YQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQ KAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQ STRILTETTKN |
| KORV_ Q9TTC1- Pro_3mut | 8,051 | LLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPM SKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQ PLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLC REEVTYLGYLLKGGKRWLTPARKATVMKIPTPTTPRQVREFLGTAGFCRLWIPGFASLAAPLYPLTRPKVPFTWTEAHQEAFGRIKEALLSAPALALPD LTKPFALYVDEKEGVARGVLTQTLGPWRRPVAYLSKKLDPVASGWPTCLKAIAAVALLLKDADKLTLGQNVLVIAPHNLESIVRQPPDRWMTNARMTH YQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQ KAELIALTQALRLAEGKSINIYTDSRYAFATAHVHGAIYKQRGWLTSAGKDIKNKEEILALLEAIHLPKRVAIIHCPGHQRGTDPVATGNRKADEAAKQAA QSTRILTETTKN |
| KORV_ Q9TTC1- Pro_3mutA | 8,052 | LLGRDLLTKLKAQIQFSTEGPQVTWEDRPAMCLVLNLEEEYRLHEKPVPPSIDPSWLQLFPMVWAEKAGMGLANQVPPVVVELKSDASPVAVRQYPM SKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQ PLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLC REEVTYLGYLLKGGKRWLTPARKATVMKIPTPTTPRQVREFLGKAGFCRLFIPGFASLAAPLYPLTRPKVPFTWTEAHQEAFGRIKEALLSAPALALPDL TKPFALYVDEKEGVARGVLTQTLGPWRRPVAYLSKKLDPVASGWPTCLKAIAAVALLLKDADKLTLGQNVLVIAPHNLESIVRQPPDRWMTNARMTHY QSLLLNERVSFAPPAILNPATLLPVESDDTPIHICSEILAEETGTRPDLRDQPLPGVPAWYTDGSSFIMDGRRQAGAAIVDNKRTVWASNLPEGTSAQK AELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQ STRILTETTKN |
| MLVAV_ P03356 | 8,053 | TLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLL PVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSP TLFDEALHRDLADFRIQHPDLILLQYVDDILLAATSELDCQQGTRALLLTLGNLGYRASAKKAQLCQKQVKYLGYLLKEGQRWLTEARKETVMGQPTPK TPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVA YLSKKLDPVAAGWPPCLRMVAAIAVLRKDAGKLTMGQPLVILAPHAVEALVKQPPDRWLSNARMTHYQAMLLDTDRVQFGPVVALNPATLLPLPEEG APHDCLEILAETHGTRPDLTDQPIPDADHTWYTDGSSFLQEGQRKAGAAVTTETEVIWARALPAGTSAQRAELIALTQALKMAEGKRLNVYTDSRYAF ATAHIHGEIYRRRGLLTSEGREIKNKSEILALLKALFLPKRLSIIHCLGHQKGDSAEARGNRLADQAAREAAIKTPPDTSTLL |
| MLVAV_ P03356_ | 8,054 | TLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLL PVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSP |

TABLE 6-continued

| Exemplary reverse transcriptase domains from retroviruses | | |
|---|---|---|
| RT Name | SEQ ID NO: | RT amino acid sequence |
| 3mut | | TLFNEALHRDLADFRIQHPDLILLQYVDDILLAATSELDCQQGTRALLLTLGNLGYRASAKKAQLCQKQVKYLGYLLKEGQRWLTEARKETVMGQPTPK<br>TPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPV<br>AYLSKKLDPVAAGWPPCLRMVAAIAVLRKDAGKLTMGQPLVILAPHAVEALVKQPPDRWLSNARMTHYQAMLLDTDRVQFGPWVALNPATLLPLPEE<br>GAPHDCLEILAETHGTRPDLTDQPIPDADHTWYTDGSSFLQEGQRKAGAAVTTETEVIWARALPAGTSAQRAELIALTQALKMAEGKRLNVYTDSRYA<br>FATAHIHGEIYRRRGWLTSEGREIKNKSEILALLKALFLPKRLSIIHCLGHQKGDSAEARGNRLADQAAREAAIKTPPDTSTLL |
| MLVAV_<br>P03356_<br>3mutA | 8,055 | TLNLEDEYRLYETSAEPEVSPGSTWLSDFPQAWAETGGMGLAVRQAPLIIPLKATSTPVSIKQYPMSQEAKLGIKPHIQRLLDQGILVPCQSPWNTPLL<br>PVKKPGTNDYRPVQDLREVNKRVEDIHPTVPNPYNLLSGLPPSHRWYTVLDLKDAFFCLRLHPTSQPLFAFEWRDPGMGISGQLTWTRLPQGFKNSP<br>TLFNEALHRDLADFRIQHPDLILLQYVDDILLAATSELDCQQGTRALLLTLGNLGYRASAKKAQLCQKQVKYLGYLLKEGQRWLTEARKETVMGQPTPK<br>TPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVA<br>YLSKKLDPVAAGWPPCLRMVAAIAVLRKDAGKLTMGQPLVILAPHAVEALVKQPPDRWLSNARMTHYQAMLLDTDRVQFGPWVALNPATLLPLPEEG<br>APHDCLEILAETHGTRPDLTDQPIPDADHTWYTDGSSFLQEGQRKAGAAVTTETEVIWARALPAGTSAQRAELIALTQALKMAEGKRLNVYTDSRYAF<br>ATAHIHGEIYRRRGWLTSEGREIKNKSEILALLKALFLPKRLSIIHCLGHQKGDSAEARGNRLADQAAREAAIKTPPDTSTLL |
| MLVBM_<br>Q7SVK7 | 8,056 | TLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPT<br>LFDEALHRDLADFRIQHPDLILLQYVDDILLAATSELDCQQGTRALLQTLGDLGYRASAKKAQICQKQVKYLGYLLREGQRWLTEARKETVMGQPVPKT<br>PRQLREFLGTAGFCRLWIPGFAEMAAPLYPLTKTGTLFSWGPDQQKAYQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQAMLLDTDRVQFGPWVALNPATLLPLPEEGAP<br>HDCLEILAETHGTRPDLTDQPIPDADHTWYTDGSSFLQEGQRKAGAAVTTETEVIWAGALPAGTSAQRAELIALTQALKMAEGKRLNVYTDSRYAFAT<br>AHIHGEIYRRRGLLTSEGREIKNKSEILALLKALFLPKRLSIIHCLGHQKGDSAEARGNRLADQAAREAAIKTPPDTSTLL |
| MLVBM_<br>Q7SVK7 | 8,057 | TLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPT<br>LFDEALHRDLADFRIQHPDLILLQYVDDILLAATSELDCQQGTRALLQTLGDLGYRASAKKAQICQKQVKYLGYLLREGQRWLTEARKETVMGQPVPKT<br>PRQLREFLGTAGFCRLWIPGFAEMAAPLYPLTKTGTLFSWGPDQQKAYQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQAMLLDTDRVQFGPWVALNPATLLPLPEEGAP<br>HDCLEILAETHGTRPDLTDQPIPDADHTWYTDGSSFLQEGQRKAGAAVTTETEVIWAGALPAGTSAQRAELIALTQALKMAEGKRLNVYTDSRYAFAT<br>AHIHGEIYRRRGLLTSEGREIKNKSEILALLKALFLPKRLSIIHCLGHQKGDSAEARGNRLADQAAREAAIKTPPDTSTLL |
| MLVBM_<br>Q7SVK7_<br>3mut | 8,058 | TLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPT<br>LFNEALHRDLADFRIQHPDLILLQYVDDILLAATSELDCQQGTRALLQTLGDLGYRASAKKAQICQKQVKYLGYLLREGQRWLTEARKETVMGQPVPKT<br>PRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGA<br>PHDCLEILAETHGTRPDLTDQPIPDADHTWYTDGSSFLQEGQRKAGAAVTTETEVIWAGALPAGTSAQRAELIALTQALKMAEGKRLNVYTDSRYAFA<br>TAHIHGEIYRRRGWLTSEGREIKNKSEILALLKALFLPKRLSIIHCLGHQKGDSAEARGNRLADQAAREAAIKTPPDTSTLL |
| MLVBM_<br>Q7SVK7_<br>3mut | 8,059 | TLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPT<br>LFNEALHRDLADFRIQHPDLILLQYVDDILLAATSELDCQQGTRALLQTLGDLGYRASAKKAQICQKQVKYLGYLLREGQRWLTEARKETVMGQPVPKT<br>PRQLREFLGTAGFCRLWIPGFAEMAAPLYPLTKPGTLFSWGPDQQKAYQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGA<br>PHDCLEILAETHGTRPDLTDQPIPDADHTWYTDGSSFLQEGQRKAGAAVTTETEVIWAGALPAGTSAQRAELIALTQALKMAEGKRLNVYTDSRYAFA<br>TAHIHGEIYRRRGWLTSEGREIKNKSEILALLKALFLPKRLSIIHCLGHQKGDSAEARGNRLADQAAREAAIKTPPDTSTLL |
| MLVBM_<br>Q7SVK7_ | 8,060 | LGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPV<br>KKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTL |

TABLE 6-continued

| Exemplary reverse transcriptase domains from retroviruses | | |
|---|---|---|
| RT Name | SEQ ID NO: | RT amino acid sequence |
| 3mutA_ WS | | FNEALHRDLADFRIQHPDLILLQYVDDILLAATSELDCQQGTRALLQTLGDLGYRASAKKAQICQKQVKYLGYLLREGQRWLTEARKETVMGQPVPKTP<br>RQLREFLGKAGFCRLFIPGFAEMAAPLYPLTKPGTLFSWGPDQQKAYQEIKQALLTAPALGLPDLTKPFELFVDEKQGYAKGVLTQKLGPWRRPVAYL<br>SKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAP<br>HDCLEILAETHGTRPDLTDQPIPDADHTWYTDGSSFLQEGQRKAGAAVTTETEVIWAGALPAGTSAQRAELIALTQALKMAEGKRLNVYTDSRYAFAT<br>AHIHGEIYRRRGWLTSEGREIKNKSEILALLKALFLPKRLSIIHCLGHQKGDSAEARGNRLADQAAREAAIKTPPDTSTLLI |
| MLVBM_ Q7SVK7_ 3mutA_ WS | 8,061 | LGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPV<br>KKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTL<br>FNEALHRDLADFRIQHPDLILLQYVDDILLAATSELDCQQGTRALLQTLGDLGYRASAKKAQICQKQVKYLGYLLREGQRWLTEARKETVMGQPVPKTP<br>RQLREFLGKAGFCRLFIPGFAEMAAPLYPLTKPGTLFSWGPDQQKAYQEIKQALLTAPALGLPDLTKPFELFVDEKQGYAKGVLTQKLGPWRRPVAYL<br>SKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAP<br>HDCLEILAETHGTRPDLTDQPIPDADHTWYTDGSSFLQEGQRKAGAAVTTETEVIWAGALPAGTSAQRAELIALTQALKMAEGKRLNVYTDSRYAFAT<br>AHIHGEIYRRRGWLTSEGREIKNKSEILALLKALFLPKRLSIIHCLGHQKGDSAEARGNRLADQAAREAAIKTPPDTSTLLI |
| MLVCB_ P08361 | 8,062 | TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFDEALHRDLAGFRIQHPDLILLQYVDDLLLAATSELDCQQGTRALLQTLGDLGYRASAKKAQICQKQVKYLGYLLKEGQRWLTEARKETVMGQPIPKT<br>PRQLREFLGTAGFCRLWIPGFAEMAAPLYPLTKTGTLFNWGPDQQKAFQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ<br>HDCLDILAEAHGTRSDLMDQPLPDADHTWYTDGSSFLQEGQRKAGAAVTTETEVIWARALPAGTSAQRAELIALTQALKMAEGKKLNVYTDSRYAFAT<br>AHIHGEIYRRRGLLTSEGKEIKNKDEILALLKALFLPKRLSIIHCPGHQKGNSAEARGNRMADQAAREVATRETPETSTLL |
| MLVCB_ P08361_ 3mut | 8,063 | TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLAGFRIQHPDLILLQYVDDLLLAATSELDCQQGTRALLQTLGDLGYRASAKKAQICQKQVKYLGYLLKEGQRWLTEARKETVMGQPIPKT<br>PRQLREFLGTAGFCRLWIPGFAEMAAPLYPLTKPGTLFNWGPDQQKAFQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQALLLDTDRVQFGPWVALNPATLLPLPEEGL<br>QHDCLDILAEAHGTRSDLMDQPLPDADHTWYTDGSSFLQEGQRKAGAAVTTETEVIWARALPAGTSAQRAELIALTQALKMAEGKKLNVYTDSRYAF<br>ATAHIHGEIYRRRGWLTSEGKEIKNKDEILALLKALFLPKRLSIIHCPGHQKGNSAEARGNRMADQAAREVATRETPETSTLL |
| MLVCB_ P08361_ 3mutA | 8,064 | TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLAGFRIQHPDLILLQYVDDLLLAATSELDCQQGTRALLQTLGDLGYRASAKKAQICQKQVKYLGYLLKEGQRWLTEARKETVMGQPIPKT<br>PRQLREFLGKAGFCRLFIPGFAEMAAPLYPLTKPGTLFNWGPDQQKAFQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ<br>HDCLDILAEAHGTRSDLMDQPLPDADHTWYTDGSSFLQEGQRKAGAAVTTETEVIWARALPAGTSAQRAELIALTQALKMAEGKKLNVYTDSRYAFAT<br>AHIHGEIYRRRGWLTSEGKEIKNKDEILALLKALFLPKRLSIIHCPGHQKGNSAEARGNRMADQAAREVATRETPETSTLL |
| MLVF5_ P26810 | 8,065 | TLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPT<br>LFDEALHRDLADFRIQHPDLILLQYVDDLLLAATSELDCQQGTRALLQTLGDLGYRASAKKAQICQKQVKYLGYLLKEGQRWLTEARKETVMGQPTPKT<br>PRQLREFLGTAGLCRLWIPGFAEMAAPLYPLTKTGTLFKWGPDQQKAYQEIKQALLTAPALGLPDLTKPFELFVDEKQGYAKGVLTQKLGPWRRPVAY<br>LSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQ<br>HDCLDILAEAHGTRPDLTDQPLPDADHTWYTDGSSFLQEGQRRAGAAVTTETEVIWAKALPAGTSAQRAELIALTQALKMAAGKKLNVYTDSRYAFAT<br>AHIHGEIYRRRGLLTSEGKEIKNKDEILALLKALFLPKRLSIIHCPGHQKGNHAEARGNRMADQAAREVATRETPETSTLL |
| MLVF5_ P26810_ | 8,066 | TLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPT |

TABLE 6-continued

Exemplary reverse transcriptase domains from retroviruses

| RT Name | SEQ ID NO: | RT amino acid sequence |
|---|---|---|
| 3mut | | LFNEALHRDLADFRIQHPDLILLQYVDDLLLAATSELDCQQGTRALLQTLGDLGYRASAKKAQICQKQVKYLGYLLKEGQRWLTEARKETVMGQPTPKT<br>PRQLREFLGTAGLCRLWIPGFAEMAAPLYPLTKPGTLFKWGPDQQKAYQEIKQALLTAPALGLPDLTKPFELFVDEKQGYAKGVLTQKLGPWRRPVAY<br>LSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQ<br>HDCLDILAEAHGTRPDLTDQPLPDADHTWYTDGSSFLQEGQRRAGAAVTTETEVIWAKALPAGTSAQRAELIALTQALKMAAGKKLNVYTDSRYAFAT<br>AHIHGEIYRRRGWLTSEGKEIKNKDEILALLKALFLPKRLSIIHCPGHQKGNHAEARGNRMADQAAREVATRETPETSTLL |
| MLVF5_ P26810_ 3mutA | 8,067 | TLNIEDEYRLHETSKGPDVPLGSTWLSDFPQAWAETGGMGLAFRQAPLIISLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPT<br>LFNEALHRDLADFRIQHPDLILLQYVDDLLLAATSELDCQQGTRALLQTLGDLGYRASAKKAQICQKQVKYLGYLLKEGQRWLTEARKETVMGQPTPKT<br>PRQLREFLGKAGLCRLFIPGFAEMAAPLYPLTKPGTLFKWGPDQQKAYQEIKQALLTAPALGLPDLTKPFELFVDEKQGYAKGVLTQKLGPWRRPVAY<br>LSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQ<br>HDCLDILAEAHGTRPDLTDQPLPDADHTWYTDGSSFLQEGQRRAGAAVTTETEVIWAKALPAGTSAQRAELIALTQALKMAAGKKLNVYTDSRYAFAT<br>AHIHGEIYRRRGWLTSEGKEIKNKDEILALLKALFLPKRLSIIHCPGHQKGNHAEARGNRMADQAAREVATRETPETSTLL |
| MLVFF_ P26809_ 3mut | 8,068 | TLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPT<br>LFNEALHRDLADFRIQHPDLILLQYVDDLLLAATSELDCQQGTRALLQTLGDLGYRASAKKAQICQKQVKYLGYLLKEGQRWLTEARKETVMGQPTPKT<br>PRQLREFLGTAGFCRLWIPGFAEMAAPLYPLTKPGTLFEWGPDQQKAYQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQ<br>HDCLDILAEAHGTRPDLTDQPLPDADHTWYTDGSSFLQEGQRKAGAAVTTETEVVWAKALPAGTSAQRAELIALTQALKMAEGKKLNVYTDSRYAFA<br>TAHIHGEIYRRRGWLTSEGKEIKNKDEILALLKALFLPKRLSIIHCPGHQKGNRAEARGNRMADQAAREVATRETPETSTLL |
| MLVFF_ P26809_ 3mutA | 8,069 | TLNIEDEYRLHETSKGPDVPLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPT<br>LFNEALHRDLADFRIQHPDLILLQYVDDLLLAATSELDCQQGTRALLQTLGDLGYRASAKKAQICQKQVKYLGYLLKEGQRWLTEARKETVMGQPTPKT<br>PRQLREFLGKAGFCRLFIPGFAEMAAPLYPLTKPGTLFEWGPDQQKAYQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQALLLDTDRVQFGPIVALNPATLLPLPEEGLQ<br>HDCLDILAEAHGTRPDLTDQPLPDADHTWYTDGSSFLQEGQRKAGAAVTTETEVVWAKALPAGTSAQRAELIALTQALKMAEGKKLNVYTDSRYAFA<br>TAHIHGEIYRRRGWLTSEGKEIKNKDEILALLKALFLPKRLSIIHCPGHQKGNRAEARGNRMADQAAREVATRETPETSTLL |
| MLVMS_ P03355 | 8,070 | TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFDEALHRDLADFRIQHPDLILLQYVDDLLLAATSELDCQQGTRALLQTLGNLGYRASAKKAQICQKQVKYLGYLLKEGQRWLTEARKETVMGQPTPKT<br>PRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGL<br>QHNCLDILAEAHGTRPDLTDQPLPDADHTWYTDGSSLLQEGQRKAGAAVTTETEVIWAKALPAGTSAQRAELIALTQALKMAEGKKLNVYTDSRYAFA<br>TAHIHGEIYRRRGLLTSEGKEIKNKDEILALLKALFLPKRLSIIHCPGHQKGHSAEARGNRMADQAARKAAITETPDTSTLL |
| MLVMS_ reference | 8,137 | TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLADFRIQHPDLILLQYVDDLLLAATSELDCQQGTRALLQTLGNLGYRASAKKAQICQKQVKYLGYLLKEGQRWLTEARKETVMGQPTPKT<br>PRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ<br>HNCLDILAEAHGTRPDLTDQPLPDADHTWYTDGSSLLQEGQRKAGAAVTTETEVIWAKALPAGTSAQRAELIALTQALKMAEGKKLNVYTDSRYAFAT<br>AHIHGEIYRRRGWLTSEGKEIKNKDEILALLKALFLPKRLSIIHCPGHQKGHSAEARGNRMADQAARKAAITETPDTSTLLIENSSP |
| MLVMS_ P03355 | 8,071 | TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT |

TABLE 6-continued

Exemplary reverse transcriptase domains from retroviruses

| RT Name | SEQ ID NO: | RT amino acid sequence |
|---|---|---|
| | | LFDEALHRDLADFRIQHPDLILLQYVDDLLLAATSELDCQQGTRALLQTLGNLGYRASAKKAQICQKQVKYLGYLLKEGQRWLTEARKETVMGQPTPKT<br>PRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQALLLDTDRVQFGPWVALNPATLLPLPEEGL<br>QHNCLDILAEAHGTRPDLTDQPLPDADHTWYTDGSSLLQEGQRKAGAAVTTETEVIWAKALPAGTSAQRAELIALTQALKMAEGKKLNVYTDSRYAFA<br>TAHIHGEIYRRRGLLTSEGKEIKNKDEILALLKALFLPKRLSIIHCPGHQKGHSAEARGNRMADQAARKAAITETPDTSTLL |
| MLVMS_<br>P03355_<br>3mut | 8,072 | TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLADFRIQHPDLILLQYVDDLLLAATSELDCQQGTRALLQTLGNLGYRASAKKAQICQKQVKYLGYLLKEGQRWLTEARKETVMGQPTPKT<br>PRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQALLLDTDRVQFGPWVALNPATLLPLPEEGL<br>QHNCLDILAEAHGTRPDLTDQPLPDADHTWYTDGSSLLQEGQRKAGAAVTTETEVIWAKALPAGTSAQRAELIALTQALKMAEGKKLNVYTDSRYAFA<br>TAHIHGEIYRRRGWLTSEGKEIKNKDEILALLKALFLPKRLSIIHCPGHQKGHSAEARGNRMADQAARKAAITETPDTSTLL |
| MLVMS_<br>P03355_<br>3mut | 8,073 | TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLADFRIQHPDLILLQYVDDLLLAATSELDCQQGTRALLQTLGNLGYRASAKKAQICQKQVKYLGYLLKEGQRWLTEARKETVMGQPTPKT<br>PRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQALLLDTDRVQFGPWVALNPATLLPLPEEGL<br>QHNCLDILAEAHGTRPDLTDQPLPDADHTWYTDGSSLLQEGQRKAGAAVTTETEVIWAKALPAGTSAQRAELIALTQALKMAEGKKLNVYTDSRYAFA<br>TAHIHGEIYRRRGWLTSEGKEIKNKDEILALLKALFLPKRLSIIHCPGHQKGHSAEARGNRMADQAARKAAITETPDTSTLL |
| MLVMS_<br>P03355_<br>3mutA_<br>WS | 8,074 | TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLADFRIQHPDLILLQYVDDLLLAATSELDCQQGTRALLQTLGNLGYRASAKKAQICQKQVKYLGYLLKEGQRWLTEARKETVMGQPTPKT<br>PRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ<br>HNCLDILAEAHGTRPDLTDQPLPDADHTWYTDGSSLLQEGQRKAGAAVTTETEVIWAKALPAGTSAQRAELIALTQALKMAEGKKLNVYTDSRYAFAT<br>AHIHGEIYRRRGWLTSEGKEIKNKDEILALLKALFLPKRLSIIHCPGHQKGHSAEARGNRMADQAARKAAITETPDTSTLL |
| MLVMS_<br>P03355_<br>3mutA_<br>WS | 8,075 | TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLADFRIQHPDLILLQYVDDLLLAATSELDCQQGTRALLQTLGNLGYRASAKKAQICQKQVKYLGYLLKEGQRWLTEARKETVMGQPTPKT<br>PRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ<br>HNCLDILAEAHGTRPDLTDQPLPDADHTWYTDGSSLLQEGQRKAGAAVTTETEVIWAKALPAGTSAQRAELIALTQALKMAEGKKLNVYTDSRYAFAT<br>AHIHGEIYRRRGWLTSEGKEIKNKDEILALLKALFLPKRLSIIHCPGHQKGHSAEARGNRMADQAARKAAITETPDTSTLL |
| MLVMS_<br>P03355_<br>PLV919 | 8,076 | TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLADFRIQHPDLILLQYVDDLLLAATSELDCQQGTRALLQTLGNLGYRASAKKAQICQKQVKYLGYLLKEGQRWLTEARKETVMGQPTPKT<br>PRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQALLLDTDRVQFGPWVALNPATLLPLPEEGLQ<br>HNCLDILAEAHGTRPDLTDQPLPDADHTWYTDGSSLLQEGQRKAGAAVTTETEVIWAKALPAGTSAQRAELIALTQALKMAEGKKLNVYTDSRYAFAT<br>AHIHGEIYRRRGWLTSEGKEIKNKDEILALLKALFLPKRLSIIHCPGHQKGHSAEARGNRMADQAARKAAITETPDTSTLLIENSSPSGGSKRTADGSEF<br>E |

TABLE 6-continued

Exemplary reverse transcriptase domains from retroviruses

| RT Name | SEQ ID NO: | RT amino acid sequence |
|---|---|---|
| MLVMS_ P03355_ PLV919 | 8,077 | TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLADFRIQHPDLILLQYVDDLLLAATSELDCQQGTRALLQTLGNLGYRASAKKAQICQKQVKYLGYLLKEGQRWLTEARKETVMGQPTPKT<br>PRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ<br>HNCLDILAEAHGTRPDLTDQPLPDADHTWYTDGSSLLQEGQRKAGAAVTTETEVIWAKALPAGTSAQRAELIALTQALKMAEGKKLNVYTDSRYAFAT<br>AHIHGEIYRRRGWLTSEGKEIKNKDEILALLKALFLPKRLSIIHCPGHQKGHSAEARGNRMADQAARKAAITETPDTSTLLIENSSPSGGSKRTADGSEF<br>E |
| MLVRD_ P11227 | 8,078 | TLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLP<br>VKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPT<br>LFDEALHRGLADFRIQHPDLILLQYVDDLLLAATSELDCQQGTRALLKTLGNLGYRASAKKAQICQKQVKYLGYLLREGQRWLTEARKETVMGQPTPKT<br>PRQLREFLGTAGFCRLWIPRFAEMAAPLYPLTKTGTLFNWGPDQQKAYHEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQAMLLDTDRVQFGPWVALNPATLLPLPEEGAP<br>HDCLEILAETHGTEPDLTDQPIPDADHTWYTDGSSFLQEGQRKAGAAVTTETEVIWARALPAGTSAQRAELIALTQALKMAEGKRLNVYTDSRYAFATA<br>HIHGEIYKRRGLLTSEGREIKNKSEILALLKALFLPKRLSIIHCLGHQKGDSAEARGNRLADQAAREAAIKTPPDTSTLL |
| MLVRD_ P11227_ 3mut | 8,079 | TLNIEDEYRLHEISTEPDVSPGSTWLSDFPQAWAETGGMGLAVRQAPLIIPLKATSTPVSIKQYPMSQEAKLGIKPHIQRLLDQGILVPCQSPWNTPLLP<br>VKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPT<br>LFNEALHRGLADFRIQHPDLILLQYVDDLLLAATSELDCQQGTRALLKTLGNLGYRASAKKAQICQKQVKYLGYLLREGQRWLTEARKETVMGQPTPKT<br>PRQLREFLGTAGFCRLWIPRFAEMAAPLYPLTKPGTLFNWGPDQQKAYHEIKQALLTAPALGLPDLTKPFELFVDEKQGYAKGVLTQKLGPWRRPVAY<br>LSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAP<br>HDCLEILAETHGTEPDLTDQPIPDADHTWYTDGSSFLQEGQRKAGAAVTTETEVIWARALPAGTSAQRAELIALTQALKMAEGKRLNVYTDSRYAFATA<br>HIHGEIYKRRGWLTSEGREIKNKSEILALLKALFLPKRLSIIHCLGHQKGDSAEARGNRLADQAAREAAIKTPPDTSTLL |
| MMTVB_ P03365 | 8,080 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMK<br>DIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAV<br>NATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDS<br>YIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLF<br>EILNGDSNPISTRKLTPEACKALQLMNERLSTARVKRLDLSQPWSLCILKTEYTPTACLWQDGVVEWIHLPHISPKVITPYDIFCTQLIIKGRHRSKELFSK<br>DPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQA<br>EIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_ P03365 | 8,081 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMK<br>DIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAV<br>NATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDS<br>YIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLF<br>EILNGDSNPISTRKLTPEACKALQLMNERLSTARVKRLDLSQPWSLCILKTEYTPTACLWQDGVVEWIHLPHISPKVITPYDIFCTQLIIKGRHRSKELFSK<br>DPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQA<br>EIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_ P03365_ 2mut | 8,082 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMK<br>DIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAV<br>NATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDS<br>YIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLF<br>EILNPDSNPISTRKLTPEACKALQLMNERLSTARVKRLDLSQPWSLCILKTEYTPTACLWQDGVVEWIHLPHISPKVITPYDIFCTQLIIKGRHRSKELFSK<br>DPDYIWVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQA<br>EIVAVITAFEEVSQPFNLYTDSKYVTGLFPEIETATLSPRTKIYTELKHLQRLIHKRQEKFYIGHIRGHTGLPGPLAQGNAYADSLTRILT |

TABLE 6-continued

| Exemplary reverse transcriptase domains from retroviruses | | |
|---|---|---|
| RT Name | SEQ ID NO: | RT amino acid sequence |
| MMTVB_<br>P03365_<br>2mut_<br>WS | 8,083 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI<br>KVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNA<br>TMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIV<br>HYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEIL<br>NPDSNPISTRKLTPEACKALQLMNERLSTARVKRLDLSQPWSLCILKTEYTPTACLWQDGWVEWIHLPHISPKVITPYDIFCTQLIIKGRHRSKELFSKDP<br>DYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIV<br>AVITAFEEVSQPFNLYTDSKYVTGLFPEIETATLSPRTKIYTELKHLQRLIHKRQEKFYIGHIRGHTGLPGPLAQGNAYADSLTRILTA |
| MMTVB_<br>P03365_<br>2mut_<br>WS | 8,084 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI<br>KVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNA<br>TMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIV<br>HYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEIL<br>NPDSNPISTRKLTPEACKALQLMNERLSTARVKRLDLSQPWSLCILKTEYTPTACLWQDGVVEWIHLPHISPKVITPYDIFCTQLIIKGRHRSKELFSKDP<br>DYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIV<br>AVITAFEEVSQPFNLYTDSKYVTGLFPEIETATLSPRTKIYTELKHLQRLIHKRQEKFYIGHIRGHTGLPGPLAQGNAYADSLTRILTA |
| MMTVB_<br>P03365_<br>2mutB | 8,085 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMK<br>DIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAV<br>NATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDS<br>YIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLF<br>EILNPDSNPISTRKLTPEACKALQLMNERLSTARVKRLDLSQPWSLCILKTEYTPTACLWQDGVVEWIHLPHISPKVITPYDIFCTQLIIKGRHRSKELFSK<br>DPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQA<br>EIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_<br>P03365_<br>2mutB | 8,086 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMK<br>DIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAV<br>NATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDS<br>YIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLF<br>EILNPDSNPISTRKLTPEACKALQLMNERLSTARVKRLDLSQPWSLCILKTEYTPTACLWQDGVVEWIHLPHISPKVITPYDIFCTQLIIKGRHRSKELFSK<br>DPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQA<br>EIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_<br>P03365_<br>2mutB_<br>WS | 8,087 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI<br>KVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNA<br>TMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIV<br>HYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEIL<br>NPDSNPISTRKLTPEACKALQLMNERLSTARVKRLDLSQPWSLCILKTEYTPTACLWQDGVVEWIHLPHISPKVITPYDIFCTQLIIKGRHRSKELFSKDP<br>DYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIV<br>AVITAFEEVSQPFNLYTDSKYVTGLFPEIETATLSPRTKIYTELKHLQRLIHKRQEKFYIGHIRGHTGLPGPLAQGNAYADSLTRILTA |
| MMTVB_<br>P03365_<br>2mutB_<br>WS | 8,088 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI<br>KVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNA<br>TMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIV<br>HYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEIL<br>NPDSNPISTRKLTPEACKALQLMNERLSTARVKRLDLSQPWSLCILKTEYTPTACLWQDGVVEWIHLPHISPKVITPYDIFCTQLIIKGRHRSKELFSKDP<br>DYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIV<br>AVITAFEEVSQPFNLYTDSKYVTGLFPEIETATLSPRTKIYTELKHLQRLIHKRQEKFYIGHIRGHTGLPGPLAQGNAYADSLTRILTA |

TABLE 6-continued

| Exemplary reverse transcriptase domains from retroviruses | | |
|---|---|---|
| RT Name | SEQ ID NO: | RT amino acid sequence |
| MMTVB_ P03365_ WS | 8,089 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI<br>KVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNA<br>TMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIV<br>HYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEIL<br>NGDSNPISTRKLTPEACKALQLMNERLSTARVKRLDLSQPWSLCILKTEYTPTACLWQDGVVEWIHLPHISPKVITPYDIFCTQLIIKGRHRSKELFSKDP<br>DYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIV<br>AVITAFEEVSQPFNLYTDSKYVTGLFPEIETATLSPRTKIYTELKHLQRLIHKRQEKFYIGHIRGHTGLPGPLAQGNAYADSLTRILTA |
| MMTVB_ P03365_ WS | 8,090 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI<br>KVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNA<br>TMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIV<br>HYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEIL<br>NGDSNPISTRKLTPEACKALQLMNERLSTARVKRLDLSQPWSLCILKTEYTPTACLWQDGWVEWIHLPHISPKVITPYDIFCTQLIIKGRHRSKELFSKDP<br>DYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIV<br>AVITAFEEVSQPFNLYTDSKYVTGLFPEIETATLSPRTKIYTELKHLQRLIHKRQEKFYIGHIRGHTGLPGPLAQGNAYADSLTRILTA |
| MMTVB_ P03365- Pro | 8,091 | GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLL<br>QDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVR<br>DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT<br>GELKPLFEILNGDSNPISTRKLTPEACKALQLMNERLSTARVKRLDLSQPWSLCILKTEYTPTACLWQDGVVEWIHLPHISPKVITPYDIFCTQLIIKGRHR<br>SKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQ<br>NTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_ P03365- Pro | 8,092 | GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLL<br>QDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVR<br>DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT<br>GELKPLFEILNGDSNPISTRKLTPEACKALQLMNERLSTARVKRLDLSQPWSLCILKTEYTPTACLWQDGVVEWIHLPHISPKVITPYDIFCTQLIIKGRHR<br>SKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQ<br>NTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_ P03365- Pro_2mut | 8,093 | GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLL<br>QDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVR<br>DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT<br>GELKPLFEILNPDSNPISTRKLTPEACKALQLMNERLSTARVKRLDLSQPWSLCILKTEYTPTACLWQDGVVEWIHLPHISPKVITPYDIFCTQLIIKGRHR<br>SKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQ<br>NTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_ P03365- Pro_2mut | 8,094 | GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLL<br>QDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVR<br>DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT<br>GELKPLFEILNPDSNPISTRKLTPEACKALQLMNERLSTARVKRLDLSQPWSLCILKTEYTPTACLWQDGVVEWIHLPHISPKVITPYDIFCTQLIIKGRHR<br>SKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQ<br>NTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_ P03365- Pro_2mutB | 8,095 | GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLL<br>QDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVR<br>DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT |

TABLE 6-continued

| Exemplary reverse transcriptase domains from retroviruses | | |
|---|---|---|
| RT Name | SEQ ID NO: | RT amino acid sequence |
| | | GELKPLFEILNPDSNPISTRKLTPEACKALQLMNERLSTARVKRLDLSQPWSLCILKTEYTPTACLWQDGVVEWIHLPHISPKVITPYDIFCTQLIIKGRHR<br>SKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQ<br>NTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_<br>P03365-<br>Pro_2mutB | 8,096 | GRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLL<br>QDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVR<br>DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT<br>GELKPLFEILNPDSNPISTRKLTPEACKALQLMNERLSTARVKRLDLSQPWSLCILKTEYTPTACLWQDGVVEWIHLPHISPKVITPYDIFCTQLIIKGRHR<br>SKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQ<br>NTAQQAEIVAVITAFEEVSQPFNLYTDSKYVTGLFPEIETATLSPRTKIYTELKHLQRLIHKRQEKFYIGHIRGHTGLPGPLAQGNAYADSLTRILT |
| MPMV_<br>P07572 | 8,097 | LTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLP<br>SPVAIPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQ<br>QVLQCFDQLKQELTAAGLHIAPEKVQLQDPYTYLGFELNGPKITNQKAVIRKDKLQTLNDFQKLLGDINWLRPYLKLTTGDLKPLFDTLKGDSDPNSHR<br>SLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDW<br>LMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPL<br>NIYTDSAYLAHSIPLLETVAQIKHISETAKLFLQCQQLIYNRSIPFYIGHVRAHSGLPGPIAQGNQRADLATKIVASNINT |
| MPMV_<br>P07572_<br>2mutB | 8,098 | LTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLP<br>SPVAPPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQ<br>QVLQCFDQLKQELTAAGLHIAPEKVQLQDPYTYLGFELNGPKITNQKAVIRKDKLQTLNDFQKLLGDINWLRPYLKLTTGDLKPLFDTLKPDSDPNSHRS<br>LSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWL<br>MQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPL<br>NIYTDSAYLAHSIPLLETVAQIKHISETAKLFLQCQQLIYNRSIPFYIGHVRAHSGLPGPIAQGNQRADLATKIVASNINT |
| PERV_<br>Q4VFZ2 | 8,099 | TLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLL<br>PVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNS<br>PTIFDEALHRDLANFRIQHPQVTLLQYVDDLLLAGATKQDCLEGTKALLLELSDLGYRASAKKAQICRREVTYLGYSLRDGQRWLTEARKKTVQIPAPT<br>TAKQVREFLGTAGFCRLWIPGFATLAAPLYPLTKEKGEFSWAPEHQKAFDAIKKALLSAPALALPDVTKPFTLYVDERKGVARGVLTQTLGPWRRPVA<br>YLSKKLDPVASGWPVCLKAIAAVAILVKDADKLTLGQNITVIAPHALENIVRQPPDRWMTNARMTHYQSLLLTERVTFAPPAALNPATLLPEETDEPVTH<br>DCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAH<br>VHGAIYKQRGLLTSAGREIKNKEEILSLLEALHLPKRLAIIHCPGHQKAKDPISRGNQMADRVAKQAAQGVNLL |
| PERV_<br>Q4VFZ2 | 8,100 | TLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLL<br>PVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNS<br>PTIFDEALHRDLANFRIQHPQVTLLQYVDDLLLAGATKQDCLEGTKALLLELSDLGYRASAKKAQICRREVTYLGYSLRDGQRWLTEARKKTVQIPAPT<br>TAKQVREFLGTAGFCRLWIPGFATLAAPLYPLTKEKGEFSWAPEHQKAFDAIKKALLSAPALALPDVTKPFTLYVDERKGVARGVLTQTLGPWRRPVA<br>YLSKKLDPVASGWPVCLKAIAAVAILVKDADKLTLGQNITVIAPHALENIVRQPPDRWMTNARMTHYQSLLLTERVTFAPPAALNPATLLPEETDEPVTH<br>DCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAH<br>VHGAIYKQRGLLTSAGREIKNKEEILSLLEALHLPKRLAIIHCPGHQKAKDPISRGNQMADRVAKQAAQGVNLL |
| PERV_<br>Q4VFZ2_<br>3mut | 8,101 | TLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLL<br>PVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNS<br>PTIFNEALHRDLANFRIQHPQVTLLQYVDDLLLAGATKQDCLEGTKALLLELSDLGYRASAKKAQICRREVTYLGYSLRDGQRWLTEARKKTVQIPAPT<br>TAKQVREFLGTAGFCRLWIPGFATLAAPLYPLTKPKGEFSWAPEHQKAFDAIKKALLSAPALALPDVTKPFTLYVDERKGVARGVLTQTLGPWRRPVA<br>YLSKKLDPVASGWPVCLKAIAAVAILVKDADKLTLGQNITVIAPHALENIVRQPPDRWMTNARMTHYQSLLLTERVTFAPPAALNPATLLPEETDEPVTH<br>DCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAH<br>VHGAIYKQRGWLTSAGREIKNKEEILSLLEALHLPKRLAIIHCPGHQKAKDPISRGNQMADRVAKQAAQGVNLL |

TABLE 6-continued

Exemplary reverse transcriptase domains from retroviruses

| RT Name | SEQ ID NO: | RT amino acid sequence |
|---|---|---|
| PERV_ Q4VFZ2_ 3mut | 8,102 | TLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLL<br>PVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNS<br>PTIFNEALHRDLANFRIQHPQVTLLQYVDDLLLAGATKQDCLEGTKALLLELSDLGYRASAKKAQICRREVTYLGYSLRDGQRWLTEARKKTVVQIPAPT<br>TAKQVREFLGTAGFCRLWIPGFATLAAPLYPLTKPKGEFSWAPEHQKAFDAIKKALLSAPALALPDVTKPFTLYVDERKGVARGVLTQTLGPWRRPVA<br>YLSKKLDPVASGWPVCLKAIAAVAILVKDADKLTLGQNITVIAPHALENIVRQPPDRWMTNARMTHYQSLLLTERVTFAPPAALNPATLLPEETDEPVTH<br>DCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAH<br>VHGAIYKQRGWLTSAGREIKNKEEILSLLEALHLPKRLAIIHCPGHQKAKDPISRGNQMADRVAKQAAQGVNLL |
| PERV_ Q4VFZ2_ 3mutA_ WS | 8,103 | LDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVR<br>KPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIF<br>NEALHRDLANFRIQHPQVTLLQYVDDLLLAGATKQDCLEGTKALLLELSDLGYRASAKKAQICRREVTYLGYSLRDGQRWLTEARKKTVVQIPAPTTAK<br>QVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSK<br>KLDPVASGWPVCLKAIAAVAILVKDADKLTLGQNITVIAPHALENIVRQPPDRWMTNARMTHYQSLLLTERVTFAPPAALNPATLLPEETDEPVTHDCHQ<br>LLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAI<br>YKQRGWLTSAGREIKNKEEILSLLEALHLPKRLAIIHCPGHQKAKDPISRGNQMADRVAKQAAQGVNLLP |
| PERV_ Q4VFZ2_ 3mutA_ WS | 8,104 | LDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVR<br>KPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIF<br>NEALHRDLANFRIQHPQVTLLQYVDDLLLAGATKQDCLEGTKALLLELSDLGYRASAKKAQICRREVTYLGYSLRDGQRWLTEARKKTVVQIPAPTTAK<br>QVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSK<br>KLDPVASGWPVCLKAIAAVAILVKDADKLTLGQNITVIAPHALENIVRQPPDRWMTNARMTHYQSLLLTERVTFAPPAALNPATLLPEETDEPVTHDCHQ<br>LLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAI<br>YKQRGWLTSAGREIKNKEEILSLLEALHLPKRLAIIHCPGHQKAKDPISRGNQMADRVAKQAAQGVNLLP |
| SFV1_ P23074 | 8,105 | MDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQL<br>TVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNT<br>PVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTAD<br>WVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFAR<br>NFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLL<br>TTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIK<br>HPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKW<br>KSIAECLQLKPDIIIMHEKGHQQPMTTLHTEGNNLADKLATQGSYVVH |
| SFV1_ P23074_ 2mut | 8,106 | MDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQL<br>TVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNT<br>PVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNAD<br>WVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFAR<br>NFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLT<br>TMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKH<br>PDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWK<br>SIAECLQLKPDIIIMHEKGHQQPMTTLHTEGNNLADKLATQGSYVVH |
| SFV1_ P23074_ 2mutA | 8,107 | MDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQL<br>TVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNT<br>PVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNAD<br>WDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFAR<br>NFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLT |

TABLE 6-continued

| Exemplary reverse transcriptase domains from retroviruses | | |
|---|---|---|
| RT Name | SEQ ID NO: | RT amino acid sequence |
| | | TMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKH<br>PDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWK<br>SIAECLQLKPDIIIMHEKGHQQPMTTLHTEGNNLADKLATQGSYVVH |
| SFV1_ P23074- Pro | 8,108 | VPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQ<br>GVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQ<br>GFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQ<br>LQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKA<br>EAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFA<br>MVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNK<br>KKPLRHVSKWKSIAECLQLKPDIIIMHEKGHQQPMTTLHTEGNNLADKLATQGSYVVH |
| SFV1_ P23074- Pro_2mut | 8,109 | VPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQ<br>GVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQ<br>GFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLK<br>QLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSK<br>AEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEF<br>AMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNN<br>KKKPLRHVSKWKSIAECLQLKPDIIIMHEKGHQQPMTTLHTEGNNLADKLATQGSYVVH |
| SFV1_ P23074- Pro_2mutA | 8,110 | VPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQ<br>GVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQ<br>GFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLK<br>QLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSK<br>AEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEF<br>AMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNN<br>KKKPLRHVSKWKSIAECLQLKPDIIIMHEKGHQQPMTTLHTEGNNLADKLATQGSYVVH |
| SFV3L_ P27401 | 8,111 | MDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTT<br>LVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTP<br>VYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADV<br>VDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFAR<br>NFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLL<br>TTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHP<br>NVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWK<br>SIADCIQLKPDIIIIHEKGHQPTASTFHTEGNNLADKLATQGSYVVN |
| SFV3L_ P27401_ 2mut | 8,112 | MDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTT<br>LVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTP<br>VYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADV<br>VDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFAR<br>NFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLL<br>TTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHP<br>NVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWK<br>SIADCIQLKPDIIIIHEKGHQPTASTFHTEGNNLADKLATQGSYVVN |
| SFV3L_ P27401_ | 8,113 | MDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTT<br>LVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTP |

TABLE 6-continued

Exemplary reverse transcriptase domains from retroviruses

| RT Name | SEQ ID NO: | RT amino acid sequence |
|---|---|---|
| 2mutA | | VYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADV<br>VDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFA<br>RNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKL<br>LTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKH<br>PNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKW<br>KSIADCIQLKPDIIIIHEKGHQPTASTFHTEGNNLADKLATQGSYVVN |
| SFV3L_<br>P27401-<br>Pro | 8,114 | IPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQ<br>GVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQ<br>GFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDL<br>KQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVY<br>TKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEF<br>SMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFN<br>NKKKPLKHVSKWKSIADCIQLKPDIIIIHEKGHQPTASTFHTEGNNLADKLATQGSYVVN |
| SFV3L_<br>P27401-<br>Pro_2mut | 8,115 | IPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQ<br>GVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQ<br>GFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDL<br>KQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVY<br>TKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEF<br>SMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFN<br>NKKKPLKHVSKWKSIADCIQLKPDIIIIHEKGHQPTASTFHTEGNNLADKLATQGSYVVN |
| SFV3L_<br>P27401-<br>Pro_2mutA | 8,116 | IPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQ<br>GVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQ<br>GFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDL<br>KQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVY<br>TKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEF<br>SMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFN<br>NKKKPLKHVSKWKSIADCIQLKPDIIIIHEKGHQPTASTFHTEGNNLADKLATQGSYVVN |
| SFVCP_<br>Q87040 | 8,117 | MNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTI<br>LVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTP<br>VYPVPKPDGRWRMVLDYREVNKTIPLTAAQNQHSAGILATIVRQKYKTTLDLANGFWAHPITPDSYWLTAFTWQGKQYCWTRLPQGFLNSPALFTAD<br>AVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNF<br>ARNFIPNFAELVQTLYNLIASSKGKYIEWTEDNTKQLNKVIEALNTASNLEERLPDQRLVIKVNTSPSAGYVRYYNESGKKPIMYLNYVFSKAELKFSMLE<br>KLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSA<br>IKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISK<br>WKSIAECLSIKPDITIQHEKGHQPINTSIHTEGNALADKLATQGSYVVN |
| SFVCP_<br>Q87040_<br>2mut | 8,118 | MNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTI<br>LVPLQEYQDRINKTALPEEQKQQLKALFTKYDNLWQHWENQVGHRKIRPHNIATGDYPPRPQKQYPINPKAKPSIQIVIDDLLKQGVLTPQNSTMNTP<br>VYPVPKPDGRWRMVLDYREVNKTIPLTAAQNQHSAGILATIVRQKYKTTLDLANGFWAHPITPDSYWLTAFTWQGKQYCWTRLPQGFLNSPALFNAD<br>AVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGLLNF<br>ARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLE<br>KLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSA<br>IKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISK<br>WKSIAECLSIKPDITIQHEKGHQPINTSIHTEGNALADKLATQGSYVVN |

TABLE 6-continued

| Exemplary reverse transcriptase domains from retroviruses | | |
|---|---|---|
| RT Name | SEQ ID NO: | RT amino acid sequence |
| SFVCP_ Q87040_ 2mutA | 8,119 | MNPLQLLQPLPAEVKGTKLLAHWNSGATITCIPESFLEDEQPIKQTLIKTIHGEKQQNVYYLTFKVKGRKVEAEVIASPYEYILLSPTDVPWLTQQPLQLTI LVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTP VYPVPKPDGRWRMVLDYREVNKTIPLTAAQNQHSAGILATIVRQKYKTTLDLANGFWAHPITPDSYWLTAFTWQGKQYCWTRLPQGFLNSPALFNAD AVDLLKEVPNVQVYVDDIYLSHDNPHEHIQQLEKVFQILLQAGYVVSLKKSEIGQRTVEFLGFNITKEGRGLTDTFKTKLLNVTPPKDLKQLQSILGKLNF ARNFIPNFAELVQTLYNLIASSPGKYIEWTEDNTKQLNKVIEALNTASNLEERLPDQRLVIKVNTSPSAGYVRYYNESGKKPIMYLNYVFSKAELKFSMLE KLLTTMHKALIKAMDLAMGQEILVYSPIVSMTKIQKTPLPERKALPIRWITWMTYLEDPRIQFHYDKTLPELKHIPDVYTSSIPPLKHPSQYEGVFCTDGSA IKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISK WKSIAECLSIKPDITIQHEKGHQPINTSIHTEGNALADKLATQGSYVVN |
| SFVCP_ Q87040- Pro | 8,120 | VPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQG VLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQ GFLNSPALFTADAVDLLKEVPNVQVYVDDIYLSHDNPHEHIQQLEKVFQILLQAGYVVSLKKSEIGQRTVEFLGFNITKEGRGLTDTFKTKLLNVTPPKDL KQLQSILGLLNFARNFIPNFAELVQTLYNLIASSKGKYIEWTEDNTKQLNKVIEALNTASNLEERLPDQRLVIKVNTSPSAGYVRYYNESGKKPIMYLNYV FSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPS QYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGF VNNKKEPLKHISKWKSIAECLSIKPDITIQHEKGHQPINTSIHTEGNALADKLATQGSYVVN |
| SFVCP_ Q87040- Pro_2mut | 8,121 | VPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQG VLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQ GFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDL KQLQSILGLLNFARNFIPNFAELVQTLYNLIASSPGKYIEWTEDNTKQLNKVIEALNTASNLEERLPDQRLVIKVNTSPSAGYVRYYNESGKKPIMYLNYV FSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPS QYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGF VNNKKEPLKHISKWKSIAECLSIKPDITIQHEKGHQPINTSIHTEGNALADKLATQGSYVVN |
| SFVCP_ Q87040- Pro_2mutA | 8,122 | VPWLTQQPLQLTILVPLQEYQDRILNKTALPEEQKQQLKALFTKYDNLWQHWENQVGHRKIRPHNIATGDYPPRPQKQYPINPKAKPSIQIVIDDLLKQG VLTPQNSTMNTPVYPVPKPDGRWRMVLDYREVNKTIPLTAAQNQHSAGILATIVRQKYKTTLDLANGFWAHPITPDSYWLTAFTWQGKQYCWTRLPQ GFLNSPALFNADAVDLLKEVPNVQVYVDDIYLSHDNPHEHIQQLEKVFQILLQAGYVVSLKKSEIGQRTVEFLGFNITKEGRGLTDTFKTKLLNVTPPKDL KQLQSILGKLNFARNFIPNFAELVQTLYNLIASSPGKYIEWTEDNTKQLNKVIEALNTASNLEERLPDQRLVIKVNTSPSAGYVRYYNESGKKPIMYLNYV FSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPS QYEGVFCTDGSAIKSPDPTKSNNAGMGIVHAIYNPEYKILNQWSIPLGHHTAQMAEIAAVEFACKKALKVPGPVLVITDSFYVAESANKELPYWKSNGF VNNKKEPLKHISKWKSIAECLSIKPDITIQHEKGHQPINTSIHTEGNALADKLATQGSYVVN |
| SMRVH_ P03364 | 8,123 | PRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPV AIPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAK ACYAHIISCLTSYGLKIAPDKVQVSEPFSYLGFELHHQQVFTPRVCLKTDHLKTLNDFQKLLGDIQWLRPYLKLPTSALVPLNNILKGDPNPLSVRALTPE AKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPY TQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTV LAHQPFNLYTDSAYIAQSVPLLETVPFIKSSTNATPLFSKLQQLILNRQHPFFIGHLRAHLNLPGPLAEGNALADAATQIFPIISD |
| SMRVH_ P03364_ 2mut | 8,124 | PRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPV AIPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAK ACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPE AKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPY TQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTV LAHQPFNLYTDSAYIAQSVPLLETVPFIKSSTNATPLFSKLQQLILNRQHPFFIGHLRAHLNLPGPLAEGNALADAATQIFPIISD |

TABLE 6-continued

Exemplary reverse transcriptase domains from retroviruses

| RT Name | SEQ ID NO: | RT amino acid sequence |
|---|---|---|
| SMRVH_ P03364_ 2mutB | 8,125 | PRSRAIDIPVPHADKISWKITDPVWVDQWPLTYEKTLAAIALVQEQLAAGHIEPTNSPWNTPIFIIKKKSGSWRLLQDLRAVNKVMVPMGALQPGLPSPV APPLNYHKIVIDLKDCFFTIPLHPEDRPYFAFSVPQINFQSPMPRYQWKVLPQGMANSPTLCQKFVAAAIAPVRSQWPEAYILHYMDDILLACDSAEAAK ACYAHIISCLTSYGLKIAPDKVQVSEPFSYLGFELHHQQVFTPRVCLKTDHLKTLNDFQKLLGDIQWLRPYLKLPTSALVPLNNILKPDPNPLSVRALTPE AKQSLALINKAIQNQSVQQISYNLPLVLLLLPTPHTPTAVFWQPNGTDPTKNGSPLLWLHLPASPSKVLLTYPSLLAMLIIKGRYTGRQLFGRDPHSIIIPY TQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTV LAHQPFNLYTDSAYIAQSVPLLETVPFIKSSTNATPLFSKLQQLILNRQHPFFIGHLRAHLNLPGPLAEGNALADAATQIFPIISD |
| SRV2_ P51517 | 8,126 | LATAVDILAPQRYADPITWKSDEPVWVDQWPLTQEKLAAAQQLVQEQLQAGHIIESNSPWNTPIFVIKKKSGKWRLLQDLRAVNATMVLMGALQPGLP SPVAIPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGE QVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRS LSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIH WLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHR ALNVYTDSAYLAHSIPLLETVSHIKHISDTAKFFLQCQQLIYNRSIPFYLGHIRAHSGLPGPLSQGNHITDLATKVVATTLTT |
| SRV2_ P51517_ 2mutB | 8,127 | LATAVDILAPQRYADPITWKSDEPVWVDQWPLTQEKLAAAQQLVQEQLQAGHIIESNSPWNTPIFVIKKKSGKWRLLQDLRAVNATMVLMGALQPGLP SPVAPPQGYFKIVIDLKDCFFTIPLQPVDQKRFAFSLPSTNFKQPMKRYQWKVLPQGMANSPTLCQKYVAAAIEPVRKSWAQMYIIHYMDDILIAGKLGE QVLQCFAQLKQALTTTGLQIAPEKVQLQDPYTYLGFQINGPKITNQKAVIRRDKLQTLNDFQKLLGDINWLRPYLHLTTGDLKPLFDILKGDSNPNSPRS LSEAALASLQKVETAIAEQFVTQIDYTQPLTFLIFNTTLTPTGLFWQNNPVMWVHLPASPKKVLLPYYDAIADLIILGRDNSKKYFGLEPSTIIQPYSKSQIH WLMQNTETWPIACASYAGNIDNHYPPNKLIQFCKLHAVVFPRIISKTPLDNALLVFTDGSSTGIAAYTFEKTTVRFKTSHTSAQLVELQALIAVLSAFPHR ALNVYTDSAYLAHSIPLLETVSHIKHISDTAKFFLQCQQLIYNRSIPFYLGHIRAHSGLPGPLSQGNHITDLATKVVATTLTT |
| WDSV_ O92815 | 8,128 | SCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHD LRAINNIVAPLTAVVASPTTVLSNLAPSLHWFTVIDLSNAFFSVPIHKDSQYLFAFTFEGHQYTWTVLPQGFIHSPTLFSQALYQSLHKIKFKISSEICIYMD DVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFL EKQLKKDTAEPFQLDDQQVEAFNKLKHAITTAPVLWPDPAKPFQLYTSHSEHASIAVLTQKHAGRTRPIAFLSSKFDAIESGLPPCLKACASIHRSLTQA DSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSD GSYTTGRGGAAVVMHRPVTDDFIIIHQQPGGASAQTAELLALAAACHLATDKTVNIYTDSRYAYGWHDFGHLWMHRGFVTSAGTPIKNHKEIEYLLKQ IMKPKQVSVIKIEAHTKGVSMEVRGNAAADEAAKNAVFLVQR |
| WDSV_ O92815_ 2mut | 8,129 | SCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHD LRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMD DVLIASKDRDTNLKDTAVMLQHLASEGHKVSKKKLQLCQQEVVYLGQLLTPEGRKILPDRKVTVSQFQQPTTIRQIRAFLGLVGYCRHWIPEFSIHSKFL EKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQA DSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSD GSYTTGRGGAAVVMHRPVTDDFIIIHQQPGGASAQTAELLALAAACHLATDKTVNIYTDSRYAYGWHDFGHLWMHRGFVTSAGTPIKNHKEIEYLLKQ IMKPKQVSVIKIEAHTKGVSMEVRGNAAADEAAKNAVFLVQR |
| WDSV_ O92815_ 2mutA | 8,130 | SCQTKNTLNIDEYLLQFPDQLWASLPTDIGRMLVPPITIKIKDNASLPSIRQYPLPKDKTEGLRPLISSLENQGILIKCHSPCNTPIFPIKKAGRDEYRMIHD LRAINNIVAPLTAVVASPTTVLSNLAPSLHWFTVIDLSNAFFSVPIHKDSQYLFAFTFEGHQYTWTVLPQGFIHSPTLFNQALYQSLHKIKFKISSEICIYMD DVLIASKDRDTNLKDTAVMLQHLASEGHKVSKKKLQLCQQEVVYLGQLLTPEGRKILPDRKVTVSQFQQPTTIRQIRAFLGKVGYCRHFIPEFSIHSKFL EKQLKPDTAEPFQLDDQQVEAFNKLKHAITTAPVLVVPDPAKPFQLYTSHSEHASIAVLTQKHAGRTRPIAFLSSKFDAIESGLPPCLKACASIHRSLTQA DSFILGAPLIIYTTHAICTLLQRDRSQLVTASRFSKWEADLLRPELTFVACSAVSPAHLYMQSCENNIPPHDCVLLTHTISRPRPDLSDLPIPDPDMTLFSD GSYTTGRGGAAVVMHRPVTDDFIIIHQQPGGASAQTAELLALAAACHLATDKTVNIYTDSRYAYGWHDFGHLWMHRGFVTSAGTPIKNHKEIEYLLKQ IMKPKQVSVIKIEAHTKGVSMEVRGNAAADEAAKNAVFLVQR |
| WMSV_ P03359 | 8,131 | VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLL PVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSP TLFDEALHRDLAPFRALNPQVVLLQYVDDLLVAAPTYRDCKEGTQKLLQELSKLGYRVSAKKAQLCQKEVTYLGYLLKEGKRWLTPARKATVMKIPPP |

TABLE 6-continued

Exemplary reverse transcriptase domains from retroviruses

| RT Name | SEQ ID NO: | RT amino acid sequence |
|---|---|---|
| | | TTPRQVREFLGTAGFCRLWIPGFASLAAPLYPLTKESIPFIWTEEHQKAFDRIKEALLSAPALALPDLTKPFTLYVDERAGVARGVLTQTLGPWRRPVAY<br>LSKKLDPVASGWPTCLKAVAAVALLLKDADKLTLGQNVTVIASHSLESIVRQPPDRWMTNARMTHYQSLLLNERVSFAPPAVLNPATLLPVESEATPVH<br>RCSEILAEETGTRRDLKDQPLPGVPAWYTDGSSFIAEGKRRAGAAIVDGKRTVWASSLPEGTSAQKAELVALTQALRLAEGKDINIYTDSRYAFATAHI<br>HGAIYKQRGLLTSAGKDIKNKEEILALLEAIHLPKRVAIIHCPGHQKGNDPVATGNRRADEAAKQAALSTRVLAETTKP |
| WMSV_<br>P03359_<br>3mut | 8,132 | VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLL<br>PVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSP<br>TLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPP<br>TTPRQVREFLGTAGFCRLWIPGFASLAAPLYPLTKPSIPFIWTEEHQKAFDRIKEALLSAPALALPDLTKPFTLYVDERAGVARGVLTQTLGPWRRPVAY<br>LSKKLDPVASGWPTCLKAVAAVALLLKDADKLTLGQNVTVIASHSLESIVRQPPDRWMTNARMTHYQSLLLNERVSFAPPAVLNPATLLPVESEATPVH<br>RCSEILAEETGTRRDLKDQPLPGVPAWYTDGSSFIAEGKRRAGAAIVDGKRTVWASSLPEGTSAQKAELVALTQALRLAEGKDINIYTDSRYAFATAHI<br>HGAIYKQRGWLTSAGKDIKNKEEILALLEAIHLPKRVAIIHCPGHQKGNDPVATGNRRADEAAKQAALSTRVLAETTKP |
| WMSV_<br>P03359_<br>3mutA | 8,133 | VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLL<br>PVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSP<br>TLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPP<br>TTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAY<br>LSKKLDPVASGWPTCLKAVAAVALLLKDADKLTLGQNVTVIASHSLESIVRQPPDRWMTNARMTHYQSLLLNERVSFAPPAVLNPATLLPVESEATPVH<br>RCSEILAEETGTRRDLKDQPLPGVPAWYTDGSSFIAEGKRRAGAAIVDGKRTVWASSLPEGTSAQKAELVALTQALRLAEGKDINIYTDSRYAFATAHI<br>HGAIYKQRGWLTSAGKDIKNKEEILALLEAIHLPKRVAIIHCPGHQKGNDPVATGNRRADEAAKQAALSTRVLAETTKP |
| XMRV6_<br>A1Z651 | 8,134 | TLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFDEALHRDLADFRIQHPDLILLQYVDDLLLAATSEQDCQRGTRALLQTLGNLGYRASAKKAQICQKQVKYLGYLLKEGQRWLTEARKETVMGQPTPK<br>TPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQAMLLDTDRVQFGPWVALNPATLLPLPEKEA<br>PHDCLEILAETHGTRPDLTDQPIPDADYTWYTDGSSFLQEGQRRAGAAVTTETEVIWARALPAGTSAQRAELIALTQALKMAEGKKLNVYTDSRYAFAT<br>AHVHGEIYRRRGLLTSEGREIKNKNEILALLKALFLPKRLSIIHCPGHQKGNSAEARGNRMADQAAREAAMKAVLETSTLL |
| XMRV6_<br>A1Z651_<br>3mut | 8,135 | TLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLADFRIQHPDLILLQYVDDLLLAATSEQDCQRGTRALLQTLGNLGYRASAKKAQICQKQVKYLGYLLKEGQRWLTEARKETVMGQPTPK<br>TPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPV<br>AYLSKKLDPVAAGWPPCLRMVAAIAVLTKDAGKLTMGQPLVILAPHAVEALVKQPPDRWLSNARMTHYQAMLLDTDRVQFGPWVALNPATLLPLPEKE<br>APHDCLEILAETHGTRPDLTDQPIPDADYTWYTDGSSFLQEGQRRAGAAVTTETEVIWARALPAGTSAQRAELIALTQALKMAEGKKLNVYTDSRYAF<br>ATAHVHGEIYRRRGWLTSEGREIKNKNEILALLKALFLPKRLSIIHCPGHQKGNSAEARGNRMADQAAREAAMKAVLETSTLL |
| XMRV6_<br>A1Z651_<br>3mutA | 8,136 | TLNIEDEYRLHETSKEPDVPLGSTWLSDFPQAWAETGGMGLAVRQAPLIIPLKATSTPVSIKQYPMSQEARLGIKPHIQRLLDQGILVPCQSPWNTPLLP<br>VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT<br>LFNEALHRDLADFRIQHPDLILLQYVDDLLLAATSEQDCQRGTRALLQTLGNLGYRASAKKAQICQKQVKYLGYLLKEGQRWLTEARKETVMGQPTPK<br>TPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVA<br>YLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEA<br>PHDCLEILAETHGTRPDLTDQPIPDADYTWYTDGSSFLQEGQRRAGAAVTTETEVIWARALPAGTSAQRAELIALTQALKMAEGKKLNVYTDSRYAFAT<br>AHVHGEIYRRRGWLTSEGREIKNKNEILALLKALFLPKRLSIIHCPGHQKGNSAEARGNRMADQAAREAAMKAVLETSTLL |

In some embodiments, reverse transcriptase domains are modified, for example by site-specific mutation. In some embodiments, reverse transcriptase domains are engineered to have improved properties, e.g. SuperScript IV (SSIV) reverse transcriptase derived from the MMLV RT. In some embodiments, the reverse transcriptase domain may be engineered to have lower error rates, e.g., as described in WO2001068895, incorporated herein by reference. In some embodiments, the reverse transcriptase domain may be engineered to be more thermostable. In some embodiments, the reverse transcriptase domain may be engineered to be more processive. In some embodiments, the reverse transcriptase domain may be engineered to have tolerance to inhibitors. In some embodiments, the reverse transcriptase domain may be engineered to be faster. In some embodiments, the reverse transcriptase domain may be engineered to better tolerate modified nucleotides in the RNA template. In some embodiments, the reverse transcriptase domain may be engineered to insert modified DNA nucleotides. In some embodiments, the reverse transcriptase domain is engineered to bind a template RNA. In some embodiments, one or more mutations are chosen from D200N, L603W, T330P, D524G, E562Q, D583N, P51L, S67R, E67K, T197A, H204R, E302K, F309N, W313F, L435G, N454K, H594Q, L671P, E69K, H8Y, T306K, or D653N in the RT domain of murine leukemia virus reverse transcriptase or a corresponding mutation at a corresponding position of another RT domain.

In some embodiments, a gene modifying polypeptide comprises the RT domain from a retroviral reverse transcriptase, e.g., a wild-type M-MLV RT, e.g., comprising the following sequence:

M-MLV (WT):

(SEQ ID NO: 5002)

TLNIEDEYRLHETSKEPDVSLGSTWLSDFPQAWAETGGMGLAVRQAPLI

IPLKATSTPVSIKQYPMSQEARLGIKPHIQRLLDQGILVPCQSPWNTPL

LPVKKPGTNDYRPVQDLREVNKRVEDIHPTVPNPYNLLSGLPPSHQWYT

VLDLKDAFFCLRLHPTSQPLFAFEWRDPEMGISGQLTWTRLPQGFKNSP

TLFDEALHRDLADFRIQHPDLILLQYVDDLLLAATSELDCQQGTRALLQ

TLGNLGYRASAKKAQICQKQVKYLGYLLKEGQRWLTEARKETVMGQPTP

KTPRQLREFLGTAGFCRLWIPGFAEMAAPLYPLTKTGTLFNWGPDQQKA

YQEIKQALLTAPALGLPDLTKPFELFVDEKQGYAKGVLTQKLGPWRRPV

AYLSKKLDPVAAGWPPCLRMVAAIAVLTKDAGKLTMGQPLVILAPHAVE

ALVKQPPDRWLSNARMTHYQALLLDTDRVQFGPVVALNPATLLPLPEEG

LQHNCLDILAEAHGTRPDLTDQPLPDADHTWYTDGSSLLQEGQRKAGAA

VTTETEVIWAKALPAGTSAQRAELIALTQALKMAEGKKLNVYTDSRYAF

ATAHIHGEIYRRRGLLTSEGKEIKNKDEILALLKALFLPKRLSIIHCPG

HQKGHSAEARGNRMADQAARKAAITETPDTSTLLI

In some embodiments, a gene modifying polypeptide comprises the RT domain from a retroviral reverse transcriptase, e.g., an M-MLV RT, e.g., comprising the following sequence:

(SEQ ID NO: 5003)

TLNIEDEHRLHETSKEPDVSLGSTWLSDFPQAWAETGGMGLAVRQAPLI

IPLKATSTPVSIKQYPMSQEARLGIKPHIQRLLDQGILVPCQSPWNTPL

LPVKKPGTNDYRPVQDLREVNKRVEDIHPTVPNPYNLLSGLPPSHQWYT

VLDLKDAFFCLRLHPTSQPLFAFEWRDPEMGISGQLTWTRLPQGFKNSP

TLFDEALHRDLADFRIQHPDLILLQYVDDLLLAATSELDCQQGTRALLQ

TLGNLGYRASAKKAQICQKQVKYLGYLLKEGQRWLTEARKETVMGQPTP

KTPRQLREFLGTAGFCRLWIPGFAEMAAPLYPLTKTGTLFNWGPDQQKA

YQEIKQALLTAPALGLPDLTKPFELFVDEKQGYAKGVLTQKLGPWRRPV

AYLSKKLDPVAAGWPPCLRMVAAIAVLTKDAGKLTMGQPLVILAPHAVE

ALVKQPPDRWLSNARMTHYQALLLDTDRVQFGPVVALNPATLLPLPEEG

LQHNCLDILAEAHGTRPDLTDQPLPDADHTWYTDGSSLLQEGQRKAGAA

VTTETEVIWAKALPAGTSAQRAELIALTQALKMAEGKKLNVYTDSRYAF

ATAHIHGEIYRRRGLLTSEGKEIKNKDEILALLKALFLPKRLSIIHCPG

HQKGHSAEARGNRMADQAARKAAITETPDTSTLL

In some embodiments, a gene modifying polypeptide comprises the RT domain from a retroviral reverse transcriptase comprising the sequence of amino acids 659-1329 of NP_057933. In embodiments, the gene modifying polypeptide further comprises one additional amino acid at the N-terminus of the sequence of amino acids 659-1329 of NP_057933, e.g., as shown below:

(SEQ ID NO: 5004)

TLNIEDEHRLHETSKEPDVSLGSTWLSDFPQAWAETGGMG

LAVRQAPLIIPLKATSTPVSIKQYPMSQEARLGIKPHIQR

LLDQGILVPCQSPWNTPLLPVKKPGTNDYRPVQDLREVNK

RVEDIHPTVPNPYNLLSGLPPSHQWYTVLDLKDAFFCLRL

HPTSQPLFAFEWRDPEMGISGQLTWTRLPQGFKNSPTLFD

EALHRDLADFRIQHPDLILLQYVDDLLLAATSELDCQQGT

RALLQTLGNLGYRASAKKAQICQKQVKYLGYLLKEGQRWL

TEARKETVMGQPTPKTPRQLREFLGTAGFCRLWIPGFAEM

AAPLYPLTKTGTLFNWGPDQQKAYQEIKQALLTAPALGLP

DLTKPFELFVDEKQGYAKGVLTQKLGPWRRPVAYLSKKLD

PVAAGWPPCLRMVAAIAVLTKDAGKLTMGQPLVILAPHAV

EALVKQPPDRWLSNARMTHYQALLLDTDRVQFGPVVALNP

ATLLPLPEEGLQHNCLDILAEAHGTRPDLTDQPLPDADHT

WYTDGSSLLQEGQRKAGAAVTTETEVIWAKALPAGTSAQR

AELIALTQALKMAEGKKLNVYTDSRYAFATAHIHGEIYRR

RGLLTSEGKEIKNKDEILALLKALFLPKRLSIIHCPGHQK

GHSAEARGNRMADQAARKAA

Core RT (bold), annotated per above

RNAseH (underlined), annotated per above

In embodiments, the gene modifying polypeptide further comprises one additional amino acid at the C-terminus of the sequence of amino acids 659-1329 of NP_057933. In embodiments, the gene modifying polypeptide comprises an RNaseH1 domain (e.g., amino acids 1178-1318 of NP_057933).

In some embodiments, a retroviral reverse transcriptase domain, e.g., M-MLV RT, may comprise one or more mutations from a wild-type sequence that may improve features of the RT, e.g., thermostability, processivity, and/or template binding. In some embodiments, an M-MLV RT domain comprises, relative to the M-MLV (WT) sequence above, one or more mutations, e.g., selected from D200N, L603W, T330P, T306K, W313F, D524G, E562Q, D583N, P51L, S67R, E67K, T197A, H204R, E302K, F309N, L435G, N454K, H594Q, D653N, R110S, K103L, e.g., a combination of mutations, such as D200N, L603W, and T330P, optionally further including T306K and W313F. In some embodiments, an M-MLV RT used herein comprises the mutations D200N, L603W, T330P, T306K and W313F. In embodiments, the mutant M-MLV RT comprises the following amino acid sequence:

```
M-MLV (PE2):
                                    (SEQ ID NO: 5005)
TLNIEDEYRLHETSKEPDVSLGSTWLSDFPQAWAETGGMG

LAVRQAPLIIPLKATSTPVSIKQYPMSQEARLGIKPHIQR

LLDQGILVPCQSPWNTPLLPVKKPGTNDYRPVQDLREVNK

RVEDIHPTVPNPYNLLSGLPPSHQWYTVLDLKDAFFCLRL

HPTSQPLFAFEWRDPEMGISGQLTWTRLPQGFKNSPTLFN

EALHRDLADFRIQHPDLILLQYVDDLLLAATSELDCQQGT

RALLQTLGNLGYRASAKKAQICQKQVKYLGYLLKEGQRWL

TEARKETVMGQPTPKTPRQLREFLGKAGFCRLFIPGFAEM

AAPLYPLTKPGTLFNWGPDQQKAYQEIKQALLTAPALGLP

DLTKPFELFVDEKQGYAKGVLTQKLGPWRRPVAYLSKKLD

PVAAGWPPCLRMVAAIAVLTKDAGKLTMGQPLVILAPHA

VEALVKQPPDRWLSNARMTHYQALLLDTDRVQFGPVVA

LNPATLLPLPEEGLQHNCLDILAEAHGTRPDLTDQPLPDA

DHTWYTDGSSLLQEGQRKAGAAVTTETEVIWAKALPAGTS

AQRAELIALTQALKMAEGKKLNVYTDSRYAFATAHIHGEI

YRRRGWLTSEGKEIKNKDEILALLKALFLPKRLSIIHCPG

HQKGHSAEARGNRMADQAARKAAITETPDTSTLLI
```

In some embodiments, a writing domain (e.g., RT domain) comprises an RNA-binding domain, e.g., that specifically binds to an RNA sequence. In some embodiments, a template RNA comprises an RNA sequence that is specifically bound by the RNA-binding domain of the writing domain.

In some embodiments, the reverse transcription domain only recognizes and reverse transcribes a specific template, e.g., a template RNA of the system. In some embodiments, the template comprises a sequence or structure that enables recognition and reverse transcription by a reverse transcription domain. In some embodiments, the template comprises a sequence or structure that enables association with an RNA-binding domain of a polypeptide component of a genome engineering system described herein. In some embodiments, the genome engineering system reverse preferably transcribes a template comprising an association sequence over a template lacking an association sequence.

The writing domain may also comprise DNA-dependent DNA polymerase activity, e.g., comprise enzymatic activity capable of writing DNA into the genome from a template DNA sequence. In some embodiments, DNA-dependent DNA polymerization is employed to complete second-strand synthesis of a target site edit. In some embodiments, the DNA-dependent DNA polymerase activity is provided by a DNA polymerase domain in the polypeptide. In some embodiments, the DNA-dependent DNA polymerase activity is provided by a reverse transcriptase domain that is also capable of DNA-dependent DNA polymerization, e.g., second-strand synthesis. In some embodiments, the DNA-dependent DNA polymerase activity is provided by a second polypeptide of the system. In some embodiments, the DNA-dependent DNA polymerase activity is provided by an endogenous host cell polymerase that is optionally recruited to the target site by a component of the genome engineering system.

In some embodiments, the reverse transcriptase domain has a lower probability of premature termination rate ($P_{off}$) in vitro relative to a reference reverse transcriptase domain. In some embodiments, the reference reverse transcriptase domain is a viral reverse transcriptase domain, e.g., the RT domain from M-MLV.

In some embodiments, the reverse transcriptase domain has a lower probability of premature termination rate ($P_{off}$) in vitro of less than about $5\times10^{-3}$/nt, $5\times10^{-4}$/nt, or $5\times10^{-6}$/nt, e.g., as measured on a 1094 nt RNA. In embodiments, the in vitro premature termination rate is determined as described in Bibillo and Eickbush (2002) J Biol Chem 277(38):34836-34845 (incorporated by reference herein its entirety).

In some embodiments, the reverse transcriptase domain is able to complete at least about 30% or 50% of integrations in cells. The percent of complete integrations can be measured by dividing the number of substantially full-length integration events (e.g., genomic sites that comprise at least 98% of the expected integrated sequence) by the number of total (including substantially full-length and partial) integration events in a population of cells. In embodiments, the integrations in cells is determined (e.g., across the integration site) using long-read amplicon sequencing, e.g., as described in Karst et al. (2020) *bioRxiv* doi.org/10.1101/645903 (incorporated by reference herein in its entirety).

In embodiments, quantifying integrations in cells comprises counting the fraction of integrations that contain at least about 75%, 80%, 85%, 90%, 95%, 96%, 97%, 98%, 99%, or 100% of the DNA sequence corresponding to the template RNA (e.g., a template RNA having a length of at least 0.05, 0.1, 0.5, 0.6, 0.7, 0.8, 0.9, 1, 1.5, 2, 3, 4, or 5 kb, e.g., a length between 0.5-0.6, 0.6-0.7, 0.7-0.8, 0.8-0.9, 1.0-1.2, 1.2-1.4, 1.4-1.6, 1.6-1.8, 1.8-2.0, 2-3, 3-4, or 4-5 kb).

In some embodiments, the reverse transcriptase domain is capable of polymerizing dNTPs in vitro. In embodiments, the reverse transcriptase domain is capable of polymerizing dNTPs in vitro at a rate between 0.1-50 nt/sec (e.g., between 0.1-1, 1-10, or 10-50 nt/sec). In embodiments, polymerization of dNTPs by the reverse transcriptase domain is measured by a single-molecule assay, e.g., as described in Schwartz and Quake (2009) *PNAS* 106(48):20294-20299 (incorporated by reference in its entirety).

In some embodiments, the reverse transcriptase domain has an in vitro error rate (e.g., misincorporation of nucleotides) of between $1\times10^{-3}$-$1\times10^{-4}$ or $1\times10^{-4}$-$1\times10^{-5}$ substitutions/nt, e.g., as described in Yasukawa et al. (2017) *Biochem Biophys Res Commun* 492(2):147-153 (incorporated herein by reference in its entirety). In some embodiments, the reverse transcriptase domain has an error rate (e.g., misincorporation of nucleotides) in cells (e.g., HEK293T cells) of between $1\times10^{-3}$-$1\times10^{-4}$ or $1\times10^{-4}$-$1\times10^{-5}$ substitutions/nt, e.g., by long-read amplicon sequencing, e.g., as described in Karst et al. (2020) *bioRxiv* doi.org/10.1101/645903 (incorporated by reference herein in its entirety).

In some embodiments, the reverse transcriptase domain is capable of performing reverse transcription of a target RNA in vitro. In some embodiments, the reverse transcriptase requires a primer of at least 3 nucleotides to initiate reverse transcription of a template. In some embodiments, reverse transcription of the target RNA is determined by detection of cDNA from the target RNA (e.g., when provided with a ssDNA primer, e.g., which anneals to the target with at least 3, 4, 5, 6, 7, 8, 9, or 10 nt at the 3' end), e.g., as described in Bibillo and Eickbush (2002) J Biol Chem 277(38):34836-34845 (incorporated herein by reference in its entirety).

In some embodiments, the reverse transcriptase domain performs reverse transcription at least 5 or 10 times more efficiently (e.g., by cDNA production), e.g., when converting its RNA template to cDNA, for example, as compared to an RNA template lacking the protein binding motif (e.g., a 3' UTR). In embodiments, efficiency of reverse transcription is measured as described in Yasukawa et al. (2017) *Biochem Biophys Res Commun* 492(2):147-153 (incorporated by reference herein in its entirety).

In some embodiments, the reverse transcriptase domain specifically binds a specific RNA template with higher frequency (e.g., about 5 or 10-fold higher frequency) than any endogenous cellular RNA, e.g., when expressed in cells (e.g., HEK293T cells). In embodiments, frequency of specific binding between the reverse transcriptase domain and the template RNA are measured by CLIP-seq, e.g., as described in Lin and Miles (2019) *Nucleic Acids Res* 47(11):5490-5501 (incorporated herein by reference in its entirety).

In some embodiments, an RT domain (e.g., as listed in Table 6) comprises one or more mutations as listed in Table 2 below. In some embodiment, an RT domain as listed in Table 6 comprises one, two, three, four, five, or six of the mutations listed in the corresponding row of Table 2 below.

TABLE 2

Exemplary RT domain mutations (relative to corresponding wild-type sequences as listed in the corresponding row of Table 6)

| RT Domain Name | Mutation(s) | | | | |
|---|---|---|---|---|---|
| AVIRE_P03360 | | | | | |
| AVIRE_P03360_3mut | D200N | G330P | L605W | | |
| AVIRE_P03360_3mutA | D200N | G330P | L605W | T306K | W313F |
| BAEVM_P10272 | | | | | |
| BAEVM_P10272_3mut | D198N | E328P | L602W | | |
| BAEVM_P10272_3mutA | D198N | E328P | L602W | T304K | W311F |
| BLVAU_P25059 | | | | | |
| BLVAU_P25059_2mut | E159Q | G286P | | | |
| BLVJ_P03361 | | | | | |
| BLVJ_P03361_2mut | E159Q | L524W | | | |
| BLVJ_P03361_2mutB | E159Q | L524W | 197P | | |
| FFV_O93209 | D21N | | | | |
| FFV_O93209_2mut | D21N | T293N | T419P | | |
| FFV_O93209_2mutA | D21N | T293N | T419P | L393K | |
| FFV_O93209-Pro | | | | | |
| FFV_O93209-Pro_2mut | T207N | T333P | | | |
| FFV_O93209-Pro_2mutA | T207N | T333P | L307K | | |
| FLV_P10273 | | | | | |
| FLV_P10273_3mut | D199N | L602W | | | |
| FLV_P10273_3mutA | D199N | L602W | T305K | W312F | |
| FOAMV_P14350 | D24N | | | | |
| FOAMV_P14350_2mut | D24N | T296N | S420P | | |
| FOAMV_P14350_2mutA | D24N | T296N | S420P | L396K | |
| FOAMV_P14350-Pro | | | | | |
| FOAMV_P14350-Pro_2mut | T207N | S331P | | | |
| FOAMV_P14350-Pro_2mutA | T207N | S331P | L307K | | |
| GALV_P21414 | | | | | |
| GALV_P21414_3mut | D198N | E328P | L600W | | |
| GALV_P21414_3mutA | D198N | E328P | L600W | T304K | W311F |
| HTL1A_P03362 | | | | | |
| HTL1A_P03362_2mut | E152Q | R279P | | | |
| HTL1A_P03362_2mutB | E152Q | R279P | L90P | | |
| HTL1C_P14078 | | | | | |
| HTL1C_P14078_2mut | E152Q | R279P | | | |
| HTL1L_P0C211 | | | | | |
| HTL1L_P0C211_2mut | E149Q | L527W | | | |
| HTL1L_P0C211_2mutB | E149Q | L527W | L87P | | |
| HTL32_Q0R5R2 | | | | | |
| HTL32_Q0R5R2_2mut | E149Q | L526W | | | |
| HTL32_Q0R5R2_2mutB | E149Q | L526W | L87P | | |
| HTL3P_Q4U0X6 | | | | | |
| HTL3P_Q4U0X6_2mut | E149Q | L526W | | | |
| HTL3P_Q4U0X6_2mutB | E149Q | L526W | L87P | | |
| HTLV2_P03363_2mut | E147Q | G274P | | | |
| JSRV_P31623 | | | | | |
| JSRV_P31623_2mutB | A100P | | | | |

TABLE 2-continued

Exemplary RT domain mutations (relative to corresponding wild-type sequences as listed in the corresponding row of Table 6)

| RT Domain Name | Mutation(s) | | | | | |
|---|---|---|---|---|---|---|
| KORV_Q9TTC1 | D32N | | | | | |
| KORV_Q9TTC1_3mut | D32N | D322N | E452P | L724W | | |
| KORV_Q9TTC1_3mutA | D32N | D322N | E452P | L724W | T428K | W435F |
| KORV_Q9TTC1-Pro | | | | | | |
| KORV_Q9TTC1-Pro_3mut | D231N | E361P | L633W | | | |
| KORV_Q9TTC1-Pro_3mutA | D231N | E361P | L633W | T337K | W344F | |
| MLVAV_P03356 | | | | | | |
| MLVAV_P03356_3mut | D200N | T330P | L603W | | | |
| MLVAV_P03356_3mutA | D200N | T330P | L603W | T306K | W313F | |
| MLVBM_Q7SVK7 | | | | | | |
| MLVBM_Q7SVK7 | | | | | | |
| MLVBM_Q7SVK7_3mut | D200N | T330P | L603W | | | |
| MLVBM_Q7SVK7_3mut | D200N | T330P | L603W | | | |
| MLVBM_Q7SVK7_3mutA_WS | D199N | T329P | L602W | T305K | W312F | |
| MLVBM_Q7SVK7_3mutA_WS | D199N | T329P | L602W | T305K | W312F | |
| MLVCB_P08361 | | | | | | |
| MLVCB_P08361_3mut | D200N | T330P | L603W | | | |
| MLVCB_P08361_3mutA | D200N | T330P | L603W | T306K | W313F | |
| MLVF5_P26810 | | | | | | |
| MLVF5_P26810_3mut | D200N | T330P | L603W | | | |
| MLVF5_P26810_3mutA | D200N | T330P | L603W | T306K | W313F | |
| MLVFF_P26809_3mut | D200N | T330P | L603W | | | |
| MLVFF_P26809_3mutA | D200N | T330P | L603W | T306K | W313F | |
| MLVMS_P03355 | | | | | | |
| MLVMS_P03355 | | | | | | |
| MLVMS_P03355_3mut | D200N | T330P | L603W | | | |
| MLVMS_P03355_3mut | D200N | T330P | L603W | | | |
| MLVMS_P03355_3mutA_WS | D200N | T330P | L603W | T306K | W313F | |
| MLVMS_P03355_3mutA_WS | D200N | T330P | L603W | T306K | W313F | |
| MLVMS_P03355_PLV919 | D200N | T330P | L603W | T306K | W313F | H8Y |
| MLVMS_P03355_PLV919 | D200N | T330P | L603W | T306K | W313F | H8Y |
| MLVRD_P11227 | | | | | | |
| MLVRD_P11227_3mut | D200N | T330P | L603W | | | |
| MMTVB_P03365 | D26N | | | | | |
| MMTVB_P03365 | D26N | | | | | |
| MMTVB_P03365_2mut | D26N | G401P | | | | |
| MMTVB_P03365_2mut_WS | G400P | | | | | |
| MMTVB_P03365_2mut_WS | G400P | | | | | |
| MMTVB_P03365_2mutB | D26N | G401P | V215P | | | |
| MMTVB_P03365_2mutB | D26N | G401P | V215P | | | |
| MMTVB_P03365_2mutB_WS | G400P | V212P | | | | |
| MMTVB_P03365_2mutB_WS | G400P | V212P | | | | |
| MMTVB_P03365_WS | | | | | | |
| MMTVB_P03365_WS | | | | | | |
| MMTVB_P03365-Pro | | | | | | |
| MMTVB_P03365-Pro | | | | | | |
| MMTVB_P03365-Pro_2mut | G309P | | | | | |
| MMTVB_P03365-Pro_2mut | G309P | | | | | |
| MMTVB_P03365-Pro_2mutB | G309P | V123P | | | | |
| MMTVB_P03365-Pro_2mutB | G309P | V123P | | | | |
| MPMV_P07572 | | | | | | |
| MPMV_P07572_2mutB | G289P | I103P | | | | |
| PERV_Q4VFZ2 | | | | | | |
| PERV_Q4VFZ2 | | | | | | |
| PERV_Q4VFZ2_3mut | D199N | E329P | L602W | | | |
| PERV_Q4VFZ2_3mut | D199N | E329P | L602W | | | |
| PERV_Q4VFZ2_3mutA_WS | D196N | E326P | L599W | T302K | W309F | |
| PERV_Q4VFZ2_3mutA_WS | D196N | E326P | L599W | T302K | W309F | |
| SFV1_P23074 | D24N | | | | | |
| SFV1_P23074_2mut | D24N | T296N | N420P | | | |
| SFV1_P23074_2mutA | D24N | T296N | N420P | L396K | | |
| SFV1_P23074-Pro | | | | | | |
| SFV1_P23074-Pro_2mut | T207N | N331P | | | | |
| SFV1_P23074-Pro_2mutA | T207N | N331P | L307K | | | |
| SFV3L_P27401 | D24N | | | | | |
| SFV3L_P27401_2mut | D24N | T296N | N422P | | | |
| SFV3L_P27401_2mutA | D24N | T296N | N422P | L396K | | |
| SFV3L_P27401-Pro | | | | | | |
| SFV3L_P27401-Pro_2mut | T307N | N333P | | | | |
| SFV3L_P27401-Pro_2mutA | T307N | N333P | L307K | | | |
| SFVCP_Q87040 | D24N | | | | | |
| SFVCP_Q87040_2mut | D24N | T296N | K422P | | | |
| SFVCP_Q87040_2mutA | D24N | T296N | K422P | L396K | | |
| SFVCP_Q87040-Pro | | | | | | |
| SFVCP_Q87040-Pro_2mut | T207N | K333P | | | | |

TABLE 2-continued

Exemplary RT domain mutations (relative to corresponding wild-type sequences as listed in the corresponding row of Table 6)

| RT Domain Name | Mutation(s) | | | | |
|---|---|---|---|---|---|
| SFVCP_Q87040-Pro_2mutA | T207N | K333P | L307K | | |
| SMRVH_P03364 | | | | | |
| SMRVH_P03364_2mut | G288P | | | | |
| SMRVH_P03364_2mutB | G288P | I102P | | | |
| SRV2_P51517 | | | | | |
| SRV2_P51517_2mutB | I103P | | | | |
| WDSV_092815 | | | | | |
| WDSV_092815_2mut | S183N | K312P | | | |
| WDSV_092815_2mutA | S183N | K312P | L288K | W295F | |
| WMSV_P03359 | | | | | |
| WMSV_P03359_3mut | D198N | E328P | L600W | | |
| WMSV_P03359_3mutA | D198N | E328P | L600W | T304K | W311F |
| XMRV6_A1Z651 | | | | | |
| XMRV6_A1Z651_3mut | D200N | T330P | L603W | | |
| XMRV6_A1Z651_3mutA | D200N | T330P | L603W | T306K | W313F |

Template Nucleic Acid Binding Domain

The gene modifying polypeptide typically contains regions capable of associating with the template nucleic acid (e.g., template RNA). In some embodiments, the template nucleic acid binding domain is an RNA binding domain. In some embodiments, the RNA binding domain is a modular domain that can associate with RNA molecules containing specific signatures, e.g., structural motifs. In other embodiments, the template nucleic acid binding domain (e.g., RNA binding domain) is contained within the reverse transcription domain, e.g., the reverse transcriptase-derived component has a known signature for RNA preference.

In other embodiments, the template nucleic acid binding domain (e.g., RNA binding domain) is contained within the target DNA binding domain. For example, in some embodiments, the DNA binding domain is a CRISPR-associated protein that recognizes the structure of a template nucleic acid (e.g., template RNA) comprising a gRNA. In some embodiments, a gene modifying polypeptide comprises a DNA-binding domain comprising a CRISPR-associated protein that associates with a gRNA scaffold that allows the DNA-binding domain to bind a target genomic DNA sequence. In some embodiments, the gRNA scaffold and gRNA spacer is comprised within the template nucleic acid (e.g., template RNA), thus the DNA-binding domain is also the template nucleic acid binding domain. In some embodiments, the polypeptide possesses RNA binding function in multiple domains, e.g., can bind a gRNA structure in a CRISPR-associated DNA binding domain and an additional sequence or structure in a reverse transcriptase domain.

In some embodiments, the RNA binding domain is capable of binding to a template RNA with greater affinity than a reference RNA binding domain. In some embodiments, the reference RNA binding domain is an RNA binding domain from Cas9 of *S. pyogenes*. In some embodiments, the RNA binding domain is capable of binding to a template RNA with an affinity between 100 pM-10 nM (e.g., between 100 pM-1 nM or 1 nM-10 nM). In some embodiments, the affinity of a RNA binding domain for its template RNA is measured in vitro, e.g., by thermophoresis, e.g., as described in Asmari et al. Methods 146:107-119 (2018) (incorporated by reference herein in its entirety). In some embodiments, the affinity of a RNA binding domain for its template RNA is measured in cells (e.g., by FRET or CLIP-Seq).

In some embodiments, the RNA binding domain is associated with the template RNA in vitro at a frequency at least about 5-fold or 10-fold higher than with a scrambled RNA. In some embodiments, the frequency of association between the RNA binding domain and the template RNA or scrambled RNA is measured by CLIP-seq, e.g., as described in Lin and Miles (2019) *Nucleic Acids Res* 47(11):5490-5501 (incorporated by reference herein in its entirety). In some embodiments, the RNA binding domain is associated with the template RNA in cells (e.g., in HEK293T cells) at a frequency at least about 5-fold or 10-fold higher than with a scrambled RNA. In some embodiments, the frequency of association between the RNA binding domain and the template RNA or scrambled RNA is measured by CLIP-seq, e.g., as described in Lin and Miles (2019), supra.

Endonuclease Domains and DNA Binding Domains

In some embodiments, a gene modifying polypeptide possesses the function of DNA target site cleavage via an endonuclease domain. In some embodiments, a gene modifying polypeptide comprises a DNA binding domain, e.g., for binding to a target nucleic acid. In some embodiments, a domain (e.g., a Cas domain) of the gene modifying polypeptide comprises two or more smaller domains, e.g., a DNA binding domain and an endonuclease domain. It is understood that when a DNA binding domain (e.g., a Cas domain) is said to bind to a target nucleic acid sequence, in some embodiments, the binding is mediated by a gRNA.

In some embodiments, a domain has two functions. For example, in some embodiments, the endonuclease domain is also a DNA-binding domain. In some embodiments, the endonuclease domain is also a template nucleic acid (e.g., template RNA) binding domain. For example, in some embodiments, a polypeptide comprises a CRISPR-associated endonuclease domain that binds a template RNA comprising a gRNA, binds a target DNA sequence (e.g., with complementarity to a portion of the gRNA), and cuts the target DNA sequence. In some embodiments, an endonuclease domain or endonuclease/DNA-binding domain from a heterologous source can be used or can be modified (e.g., by insertion, deletion, or substitution of one or more residues) in a gene modifying system described herein.

In some embodiments, a nucleic acid encoding the endonuclease domain or endonuclease/DNA binding domain is altered from its natural sequence to have altered codon usage, e.g. improved for human cells. In some embodiments, the endonuclease element is a heterologous endonuclease element, such as a Cas endonuclease (e.g., Cas9), a type-II restriction endonuclease (e.g., Fok1), a meganuclease (e.g., I-SceI), or other endonuclease domain.

In certain aspects, the DNA-binding domain of a gene modifying polypeptide described herein is selected, designed, or constructed for binding to a desired host DNA target sequence. In certain embodiments, the DNA-binding domain of the polypeptide is a heterologous DNA-binding element. In some embodiments the heterologous DNA binding element is a zinc-finger element or a TAL effector element, e.g., a zinc-finger or TAL polypeptide or functional fragment thereof. In some embodiments the heterologous DNA binding element is a sequence-guided DNA binding element, such as Cas9, Cpf1, or other CRISPR-related protein that has been altered to have no endonuclease activity. In some embodiments the heterologous DNA binding element retains endonuclease activity. In some embodiments, the heterologous DNA binding element retains partial endonuclease activity to cleave ssDNA, e.g., possesses nickase activity. In specific embodiments, the heterologous DNA-binding domain can be any one or more of Cas9, TAL domain, ZF domain, Myb domain, combinations thereof, or multiples thereof.

In some embodiments, DNA-binding domains are modified, for example by site-specific mutation, increasing or decreasing DNA-binding elements (for example, number and/or specificity of zinc fingers), etc., to alter DNA-binding specificity and affinity. In some embodiments a nucleic acid sequence encoding the DNA binding domain is altered from its natural sequence to have altered codon usage, e.g. improved for human cells. In embodiments, the DNA binding domain comprises one or more modifications relative to a wild-type DNA binding domain, e.g., a modification via directed evolution, e.g., phage-assisted continuous evolution (PACE).

In some embodiments, the DNA binding domain comprises a meganuclease domain (e.g., as described herein, e.g., in the endonuclease domain section), or a functional fragment thereof. In some embodiments, the meganuclease domain possesses endonuclease activity, e.g., double-strand cleavage and/or nickase activity. In other embodiments, the meganuclease domain has reduced activity, e.g., lacks endonuclease activity, e.g., the meganuclease is catalytically inactive. In some embodiments, a catalytically inactive meganuclease is used as a DNA binding domain, e.g., as described in Fonfara et al. Nucleic Acids Res 40(2):847-860 (2012), incorporated herein by reference in its entirety.

In some embodiments, a gene modifying polypeptide comprises a modification to a DNA-binding domain, e.g., relative to the wild-type polypeptide. In some embodiments, the DNA-binding domain comprises an addition, deletion, replacement, or modification to the amino acid sequence of the original DNA-binding domain. In some embodiments, the DNA-binding domain is modified to include a heterologous functional domain that binds specifically to a target nucleic acid (e.g., DNA) sequence of interest. In some embodiments, the functional domain replaces at least a portion (e.g., the entirety of) the prior DNA-binding domain of the polypeptide. In some embodiments, the functional domain comprises a zinc finger (e.g., a zinc finger that specifically binds to the target nucleic acid (e.g., DNA) sequence of interest. In some embodiments, the functional domain comprises a Cas domain (e.g., a Cas domain that specifically binds to the target nucleic acid (e.g., DNA) sequence of interest. In some embodiments, the Cas domain comprises a Cas9 or a mutant or variant thereof (e.g., as described herein). In embodiments, the Cas domain is associated with a guide RNA (gRNA), e.g., as described herein. In embodiments, the Cas domain is directed to a target nucleic acid (e.g., DNA) sequence of interest by the gRNA. In embodiments, the Cas domain is encoded in the same nucleic acid (e.g., RNA) molecule as the gRNA. In embodiments, the Cas domain is encoded in a different nucleic acid (e.g., RNA) molecule from the gRNA.

In some embodiments, the DNA binding domain is capable of binding to a target sequence (e.g., a dsDNA target sequence) with greater affinity than a reference DNA binding domain. In some embodiments, the reference DNA binding domain is a DNA binding domain from Cas9 of *S. pyogenes*. In some embodiments, the DNA binding domain is capable of binding to a target sequence (e.g., a dsDNA target sequence) with an affinity between 100 pM-10 nM (e.g., between 100 pM-1 nM or 1 nM-10 nM).

In some embodiments, the affinity of a DNA binding domain for its target sequence (e.g., dsDNA target sequence) is measured in vitro, e.g., by thermophoresis, e.g., as described in Asmari et al. Methods 146:107-119 (2018) (incorporated by reference herein in its entirety).

In embodiments, the DNA binding domain is capable of binding to its target sequence (e.g., dsDNA target sequence), e.g, with an affinity between 100 pM-10 nM (e.g., between 100 pM-1 nM or 1 nM-10 nM) in the presence of a molar excess of scrambled sequence competitor dsDNA, e.g., of about 100-fold molar excess.

In some embodiments, the DNA binding domain is found associated with its target sequence (e.g., dsDNA target sequence) more frequently than any other sequence in the genome of a target cell, e.g., human target cell, e.g., as measured by ChIP-seq (e.g., in HEK293T cells), e.g., as described in He and Pu (2010) *Curr. Protoc Mol Biol* Chapter 21 (incorporated herein by reference in its entirety). In some embodiments, the DNA binding domain is found associated with its target sequence (e.g., dsDNA target sequence) at least about 5-fold or 10-fold, more frequently than any other sequence in the genome of a target cell, e.g., as measured by ChIP-seq (e.g., in HEK293T cells), e.g., as described in He and Pu (2010), supra.

In some embodiments, the endonuclease domain has nickase activity and cleaves one strand of a target DNA. In some embodiments, nickase activity reduces the formation of double-stranded breaks at the target site. In some embodiments, the endonuclease domain creates a staggered nick structure in the first and second strands of a target DNA. In some embodiments, a staggered nick structure generates free 3' overhangs at the target site. In some embodiments, free 3' overhangs at the target site improve editing efficiency, e.g., by enhancing access and annealing of a 3' homology region of a template nucleic acid. In some embodiments, a staggered nick structure reduces the formation of double-stranded breaks at the target site.

In some embodiments, the endonuclease domain cleaves both strands of a target DNA, e.g., results in blunt-end cleavage of a target with no ssDNA overhangs on either side of the cut-site. The amino acid sequence of an endonuclease domain of a gene modifying system described herein may be at least about 50%, at least about 60%, at least about 70%, at least about 80%, at least about 85%, at least about 90%, at least about 95%, at least about 96%, at least about 97%, at least about 98%, at least about 99% identical to the amino acid sequence of an endonuclease domain described herein, e.g., an endonuclease domain from Table 8.

In certain embodiments, the heterologous endonuclease is Fok1 or a functional fragment thereof. In certain embodiments, the heterologous endonuclease is a Holliday junction resolvase or homolog thereof, such as the Holliday junction resolving enzyme from *Sulfolobus solfataricus*—Ssol Hje (Govindaraju et al., *Nucleic Acids Research* 44:7, 2016). In certain embodiments, the heterologous endonuclease is the endonuclease of the large fragment of a spliceosomal protein, such as Prp8 (Mahbub et al., *Mobile DNA* 8:16, 2017). In certain embodiments, the heterologous endonuclease is derived from a CRISPR-associated protein, e.g., Cas9. In certain embodiments, the heterologous endonuclease is engineered to have only ssDNA cleavage activity, e.g., only nickase activity, e.g., be a Cas9 nickase, e.g., SpCas9 with D10A, H840A, or N863A mutations. Table 8 provides exemplary Cas proteins and mutations associated with nickase activity. In still other embodiments, homologous endonuclease domains are modified, for example by site-specific mutation, to alter DNA endonuclease activity. In still other embodiments, endonuclease domains are modified to reduce DNA-sequence specificity, e.g., by truncation to remove domains that confer DNA-sequence specificity or mutation to inactivate regions conferring DNA-sequence specificity.

In some embodiments, the endonuclease domain has nickase activity and does not form double-stranded breaks. In some embodiments, the endonuclease domain forms single-stranded breaks at a higher frequency than double-stranded breaks, e.g., at least 90%, 95%, 96%, 97%, 98%, or 99% of the breaks are single-stranded breaks, or less than 10%, 5%, 4%, 3%, 2%, or 1% of the breaks are double-stranded breaks. In some embodiments, the endonuclease forms substantially no double-stranded breaks. In some embodiments, the endonuclease does not form detectable levels of double-stranded breaks.

In some embodiments, the endonuclease domain has nickase activity that nicks the target site DNA of the first strand; e.g., in some embodiments, the endonuclease domain cuts the genomic DNA of the target site near to the site of alteration on the strand that will be extended by the writing domain. In some embodiments, the endonuclease domain has nickase activity that nicks the target site DNA of the first strand and does not nick the target site DNA of the second strand. For example, when a polypeptide comprises a CRISPR-associated endonuclease domain having nickase activity, in some embodiments, said CRISPR-associated endonuclease domain nicks the target site DNA strand containing the PAM site (e.g., and does not nick the target site DNA strand that does not contain the PAM site). As a further example, when a polypeptide comprises a CRISPR-associated endonuclease domain having nickase activity, in some embodiments, said CRISPR-associated endonuclease domain nicks the target site DNA strand not containing the PAM site (e.g., and does not nick the target site DNA strand that contains the PAM site).

In some other embodiments, the endonuclease domain has nickase activity that nicks the target site DNA of the first strand and the second strand. Without wishing to be bound by theory, after a writing domain (e.g., RT domain) of a polypeptide described herein polymerizes (e.g., reverse transcribes) from the heterologous object sequence of a template nucleic acid (e.g., template RNA), the cellular DNA repair machinery must repair the nick on the first DNA strand. The target site DNA now contains two different sequences for the first DNA strand: one corresponding to the original genomic DNA (e.g., having a free 5' end) and a second corresponding to that polymerized from the heterologous object sequence (e.g., having a free 3' end). It is thought that the two different sequences equilibrate with one another, first one hybridizing the second strand, then the other, and which sequence the cellular DNA repair apparatus incorporates into its repaired target site may be a stochastic process. Without wishing to be bound by theory, it is thought that introducing an additional nick to the second-strand may bias the cellular DNA repair machinery to adopt the heterologous object sequence-based sequence more frequently than the original genomic sequence (Anzalone et al. Nature 576:149-157 (2019)). In some embodiments, the additional nick is positioned at least 10, 15, 20, 25, 30, 35, 40, 45, 50, 55, 60, 65, 70, 75, 80, 85, 90, 95, 100, 105, 110, 115, 120, 125, 130, 135, 140, 145, or 150 nucleotides 5' or 3' of the target site modification (e.g., the insertion, deletion, or substitution) or to the nick on the first strand.

Alternatively or additionally, without wishing to be bound by theory, it is thought that an additional nick to the second strand may promote second-strand synthesis. In some embodiments, where the gene modifying system has inserted or substituted a portion of the first strand, synthesis of a new sequence corresponding to the insertion/substitution in the second strand is necessary.

In some embodiments, the polypeptide comprises a single domain having endonuclease activity (e.g., a single endonuclease domain) and said domain nicks both the first strand and the second strand. For example, in such an embodiment the endonuclease domain may be a CRISPR-associated endonuclease domain, and the template nucleic acid (e.g., template RNA) comprises a gRNA spacer that directs nicking of the first strand and an additional gRNA spacer that directs nicking of the second strand. In some embodiments, the polypeptide comprises a plurality of domains having endonuclease activity, and a first endonuclease domain nicks the first strand and a second endonuclease domain nicks the second strand (optionally, the first endonuclease domain does not (e.g., cannot) nick the second strand and the second endonuclease domain does not (e.g., cannot) nick the first strand).

In some embodiments, the endonuclease domain is capable of nicking a first strand and a second strand. In some embodiments, the first and second strand nicks occur at the same position in the target site but on opposite strands. In some embodiments, the second strand nick occurs in a staggered location, e.g., upstream or downstream, from the first nick. In some embodiments, the endonuclease domain generates a target site deletion if the second strand nick is upstream of the first strand nick. In some embodiments, the endonuclease domain generates a target site duplication if the second strand nick is downstream of the first strand nick. In some embodiments, the endonuclease domain generates no duplication and/or deletion if the first and second strand nicks occur in the same position of the target site. In some embodiments, the endonuclease domain has altered activity depending on protein conformation or RNA-binding status, e.g., which promotes the nicking of the first or second strand (e.g., as described in Christensen et al. PNAS 2006; incorporated by reference herein in its entirety).

In some embodiments, the endonuclease domain comprises a meganuclease, or a functional fragment thereof. In some embodiments, the endonuclease domain comprises a homing endonuclease, or a functional fragment thereof. In some embodiments, the endonuclease domain comprises a meganuclease from the LAGLIDADG (SEQ ID NO: 37638), GIY-YIG, HNH, His-Cys Box, or PD-(D/E) XK families, or a functional fragment or variant thereof, e.g., which possess conserved amino acid motifs, e.g., as indicated in the family names. In some embodiments, the endonuclease domain comprises a meganuclease, or fragment thereof, chosen from, e.g., I-SmaMI (Uniprot F7WD42), I-SeeI (Uniprot P03882), I-AniI (Uniprot P03880), I-DmoI (Uniprot P21505), I-CreI (Uniprot P05725), I-TeeI (Uniprot P13299), I-OnuI (Uniprot Q4VWW5), or I-BmoI (Uniprot Q9ANR6). In some embodiments, the meganuclease is naturally monomeric, e.g., I-SeeI, I-TeeI, or dimeric, e.g., I-CreI, in its functional form. For example, the LAGLIDADG meganucleases (SEQ ID NO: 37638) with a single copy of the LAGLIDADG motif (SEQ ID NO: 37638) generally form homodimers, whereas members with two copies of the LAGLIDADG motif (SEQ ID NO: 37638) are generally found as monomers. In some embodiments, a meganuclease that normally forms as a dimer is expressed as a fusion, e.g., the two subunits are expressed as a single ORF and, optionally, connected by a linker, e.g., an I-CreI dimer fusion (Rodriguez-Fornes et al. Gene Therapy 2020; incorporated by reference herein in its entirety). In some embodiments, a meganuclease, or a functional fragment thereof, is altered to favor nickase activity for one strand of a double-stranded DNA molecule, e.g., I-SceI (K122I and/or K223I) (Niu et al. J Mol Biol 2008), I-AniI (K227M) (McConnell Smith et al. PNAS 2009), I-DmoI (Q42A and/or K120M) (Molina et al. J Biol Chem 2015). In some embodiments, a meganuclease or functional fragment thereof possessing this preference for single-strand cleavage is used as an endonuclease domain, e.g., with nickase activity. In some embodiments, an endonuclease domain comprises a meganuclease, or a functional fragment thereof, which naturally targets or is engineered to target a safe harbor site, e.g., an I-CreI targeting SH6 site (Rodriguez-Fomes et al., supra). In some embodiments, an endonuclease domain comprises a meganuclease, or a functional fragment thereof, with a sequence tolerant catalytic domain, e.g., I-TeeI recognizing the minimal motif CNNNG (Kleinstiver et al. PNAS 2012). In some embodiments, a target sequence tolerant catalytic domain is fused to a DNA binding domain, e.g., to direct activity, e.g., by fusing I-TeeI to: (i) zinc fingers to create Tev-ZFEs (Kleinstiver et al. PNAS 2012), (ii) other meganucleases to create MegaTevs (Wolfs et al. Nucleic Acids Res 2014), and/or (iii) Cas9 to create TevCas9 (Wolfs et al. PNAS 2016).

In some embodiments, the endonuclease domain comprises a restriction enzyme, e.g., a Type IIS or Type IIP restriction enzyme. In some embodiments, the endonuclease domain comprises a Type IIS restriction enzyme, e.g., FokI, or a fragment or variant thereof. In some embodiments, the endonuclease domain comprises a Type IIP restriction enzyme, e.g., PvuII, or a fragment or variant thereof. In some embodiments, a dimeric restriction enzyme is expressed as a fusion such that it functions as a single chain, e.g., a FokI dimer fusion (Minczuk et al. Nucleic Acids Res 36(12):3926-3938 (2008)).

The use of additional endonuclease domains is described, for example, in Guha and Edgell Int J Mol Sci 18(22):2565 (2017), which is incorporated herein by reference in its entirety.

In some embodiments, a gene modifying polypeptide comprises a modification to an endonuclease domain, e.g., relative to a wild-type Cas protein. In some embodiments, the endonuclease domain comprises an addition, deletion, replacement, or modification to the amino acid sequence of the wild-type Cas protein. In some embodiments, the endonuclease domain is modified to include a heterologous functional domain that binds specifically to and/or induces endonuclease cleavage of a target nucleic acid (e.g., DNA) sequence of interest. In some embodiments, the endonuclease domain comprises a zinc finger. In embodiments, the endonuclease domain comprising the Cas domain is associated with a guide RNA (gRNA), e.g., as described herein.

In some embodiments, the endonuclease domain is modified to include a functional domain that does not target a specific target nucleic acid (e.g., DNA) sequence. In embodiments, the endonuclease domain comprises a Fok1 domain.

In some embodiments, the endonuclease domain is associated with the target dsDNA in vitro at a frequency at least about 5-fold or 10-fold higher than with a scrambled dsDNA. In some embodiments, the endonuclease domain is associated with the target dsDNA in vitro at a frequency at least about 5-fold or 10-fold higher than with a scrambled dsDNA, e.g., in a cell (e.g., a HEK293T cell). In some embodiments, the frequency of association between the endonuclease domain and the target DNA or scrambled DNA is measured by ChIP-seq, e.g., as described in He and Pu (2010) *Curr. Protoc Mol Biol* Chapter 21 (incorporated by reference herein in its entirety).

In some embodiments, the endonuclease domain can catalyze the formation of a nick at a target sequence, e.g., to an increase of at least about 5-fold or 10-fold relative to a non-target sequence (e.g., relative to any other genomic sequence in the genome of the target cell). In some embodiments, the level of nick formation is determined using NickSeq, e.g., as described in Elacqua et al. (2019) *bioRxiv* doi.org/10.1101/867937 (incorporated herein by reference in its entirety).

In some embodiments, the endonuclease domain is capable of nicking DNA in vitro. In embodiments, the nick results in an exposed base. In embodiments, the exposed base can be detected using a nuclease sensitivity assay, e.g., as described in Chaudhry and Weinfeld (1995) *Nucleic Acids Res* 23(19):3805-3809 (incorporated by reference herein in its entirety). In embodiments, the level of exposed bases (e.g., detected by the nuclease sensitivity assay) is increased by at least 10%, 50%, or more relative to a reference endonuclease domain. In some embodiments, the reference endonuclease domain is an endonuclease domain from Cas9 of *S. pyogenes.*

In some embodiments, the endonuclease domain is capable of nicking DNA in a cell. In embodiments, the endonuclease domain is capable of nicking DNA in a HEK293T cell. In embodiments, an unrepaired nick that undergoes replication in the absence of Rad51 results in increased NHEJ rates at the site of the nick, which can be detected, e.g., by using a Rad51 inhibition assay, e.g., as described in Bothmer et al. (2017) *Nat Commun* 8:13905 (incorporated by reference herein in its entirety). In embodiments, NHEJ rates are increased above 0-5%. In embodiments, NHEJ rates are increased to 20-70% (e.g., between 30%-60% or 40-50%), e.g., upon Rad51 inhibition.

In some embodiments, the endonuclease domain releases the target after cleavage. In some embodiments, release of the target is indicated indirectly by assessing for multiple turnovers by the enzyme, e.g., as described in Yourik at al. RNA 25(1):35-44 (2019) (incorporated herein by reference in its entirety) and shown in FIG. 2. In some embodiments, the $k_{exp}$ of an endonuclease domain is $1\times10^{-3}$-$1\times10^{-5}$ min−1 as measured by such methods.

In some embodiments, the endonuclease domain has a catalytic efficiency ($k_{cat}/K_m$) greater than about $1\times10^8$ $s^{-1}$ $M^{-1}$ in vitro. In embodiments, the endonuclease domain has a catalytic efficiency greater than about $1\times10^5$, $1\times10^6$, $1\times10^7$, or $1\times10^8$, $s^{-1}$ $M^{-1}$ in vitro. In embodiments, catalytic efficiency is determined as described in Chen et al. (2018) *Science* 360(6387):436-439 (incorporated herein by reference in its entirety). In some embodiments, the endonuclease domain has a catalytic efficiency ($k_{cat}/K_m$) greater than about $1\times10^8$ $s^{-1}$ $M^{-1}$ in cells. In embodiments, the endonuclease domain has a catalytic efficiency greater than about $1\times10^5$, $1\times10^6$, $1\times10^7$, or $1\times10^8$ $s^{-1}$ $M^{-1}$ in cells.

Gene Modifying Polypeptides Comprising Cas Domains

In some embodiments, a gene modifying polypeptide described herein comprises a Cas domain. In some embodiments, the Cas domain can direct the gene modifying polypeptide to a target site specified by a gRNA spacer, thereby modifying a target nucleic acid sequence in "cis". In some embodiments, a gene modifying polypeptide is fused to a Cas domain. In some embodiments, a gene modifying polypeptide comprises a CRISPR/Cas domain (also referred to herein as a CRISPR-associated protein). In some embodiments, a CRISPR/Cas domain comprises a protein involved in the clustered regulatory interspaced short palindromic repeat (CRISPR) system, e.g., a Cas protein, and optionally binds a guide RNA, e.g., single guide RNA (sgRNA).

CRISPR systems are adaptive defense systems originally discovered in bacteria and archaea. CRISPR systems use RNA-guided nucleases termed CRISPR-associated or "Cas" endonucleases (e. g., Cas9 or Cpf1) to cleave foreign DNA. For example, in a typical CRISPR-Cas system, an endonuclease is directed to a target nucleotide sequence (e. g., a site in the genome that is to be sequence-edited) by sequence-specific, non-coding "guide RNAs" that target single- or double-stranded DNA sequences. Three classes (I-III) of CRISPR systems have been identified. The class II CRISPR systems use a single Cas endonuclease (rather than multiple Cas proteins). One class II CRISPR system includes a type II Cas endonuclease such as Cas9, a CRISPR RNA ("crRNA"), and a trans-activating crRNA ("tracrRNA"). The crRNA contains a "spacer" sequence, a typically about 20-nucleotide RNA sequence that corresponds to a target DNA sequence ("protospacer"). In the wild-type system, and in some engineered systems, crRNA also contains a region that binds to the tracrRNA to form a partially double-stranded structure that is cleaved by RNase III, resulting in a crRNA/tracrRNA hybrid molecule. A crRNA/tracrRNA hybrid then directs the Cas endonuclease to recognize and cleave a target DNA sequence. A target DNA sequence is generally adjacent to a "protospacer adjacent motif" ("PAM") that is specific for a given Cas endonuclease and required for cleavage activity at a target site matching the spacer of the crRNA. CRISPR endonucleases identified from various prokaryotic species have unique PAM sequence requirements, e.g., as listed for exemplary Cas enzymes in Table 7; examples of PAM sequences include 5'-NGG (*Streptococcus pyogenes*), 5'-NNAGAA (*Streptococcus thermophilus* CRISPR1), 5'-NGGNG (*Streptococcus thermophilus* CRISPR3), and 5'-NNNNGATT (*Neisseria* meningiditis). Some endonucleases, e.g., Cas9 endonucleases, are associated with G-rich PAM sites, e. g., 5'-NGG), and perform blunt-end cleaving of the target DNA at a location 3 nucleotides upstream from (5' from) the PAM site. Another class II CRISPR system includes the type V endonuclease Cpf1, which is smaller than Cas9; examples include AsCpf1 (from *Acidaminococcus* sp.) and LbCpf1 (from Lachnospiraceae sp.). Cpf1-associated CRISPR arrays are processed into mature crRNAs without the requirement of a tracrRNA; in other words, a Cpf1 system, in some embodiments, comprises only Cpf1 nuclease and a crRNA to cleave a target DNA sequence. Cpf1 endonucleases, are typically associated with T-rich PAM sites, e. g., 5'-TTN. Cpf1 can also recognize a 5'-CTA PAM motif. Cpf1 typically cleaves a target DNA by introducing an offset or staggered double-strand break with a 4- or 5-nucleotide 5' overhang, for example, cleaving a target DNA with a 5-nucleotide offset or staggered cut located 18 nucleotides downstream from (3' from) from a PAM site on the coding strand and 23 nucleotides downstream from the PAM site on the complimentary strand; the 5-nucleotide overhang that results from such offset cleavage allows more precise genome editing by DNA insertion by homologous recombination than by insertion at blunt-end cleaved DNA. See, e.g., Zetsche et al. (2015) Cell, 163:759-771.

A variety of CRISPR associated (Cas) genes or proteins can be used in the technologies provided by the present disclosure and the choice of Cas protein will depend upon the particular conditions of the method. Specific examples of Cas proteins include class II systems including Cas1, Cas2, Cas3, Cas4, Cas5, Cash, Cas7, Cas8, Cas9, Cas10, Cpf1, C2C1, or C2C3. In some embodiments, a Cas protein, e.g., a Cas9 protein, may be from any of a variety of prokaryotic species. In some embodiments a particular Cas protein, e.g., a particular Cas9 protein, is selected to recognize a particular protospacer-adjacent motif (PAM) sequence. In some embodiments, a DNA-binding domain or endonuclease domain includes a sequence targeting polypeptide, such as a Cas protein, e.g., Cas9. In certain embodiments a Cas protein, e.g., a Cas9 protein, may be obtained from a bacteria or archaea or synthesized using known methods. In certain embodiments, a Cas protein may be from a gram-positive bacteria or a gram-negative bacteria. In certain embodiments, a Cas protein may be from a *Streptococcus* (e.g., a *S. pyogenes*, or a *S. thermophilus*), a *Francisella* (e.g., an *F. novicida*), a *Staphylococcus* (e.g., an *S. aureus*), an *Acidaminococcus* (e.g., an *Acidaminococcus* sp. BV3L6), a *Neisseria* (e.g., an *N. meningitidis*), a *Cryptococcus*, a *Corynebacterium*, a *Haemophilus*, a *Eubacterium*, a *Pasteurella*, a *Prevotella*, a *Veillonella*, or a *Marinobacter*.

In some embodiments, a gene modifying polypeptide may comprise the amino acid sequence of SEQ ID NO: 4000 below, or a sequence having at least 70%, 75%, 80%, 85%, 90%, 95%, 96%, 97%, 98%, 99% identity thereto. In embodiments, the amino acid sequence of SEQ ID NO: 4000 below, or the sequence having at least 70%, 75%, 80%, 85%, 90%, 95%, 96%, 97%, 98%, 99% identity thereto, is positioned at the N-terminal end of the gene modifying polypeptide. In embodiments, the amino acid sequence of SEQ ID NO: 4000 below, or the sequence having at least 70%, 75%, 80%, 85%, 90%, 95%, 96%, 97%, 98%, 99% identity thereto, is positioned within 1, 2, 3, 4, 5, 6, 7, 8, 9, 10, 15, 20, 25, or 30 amino acids of the N-terminal end of the gene modifying polypeptide.

```
Exemplary N-terminal NLS-Cas9 domain
                                    (SEQ ID NO: 4000)
MPAAKRVKLDGGDKKYSIGLDIGTNSVGWAVITDEYKVPS

KKFKVLGNTDRHSIKKNLIGALLFDSGETAEATRLKRTAR

RRYTRRKNRICYLQEIFSNEMAKVDDSFFHRLEESFLVE

EDKKHERHPIFGNIVDEVAYHEKYPTIYHLRKKLVDSTD

KADLRLIYLALAHMIKFRGHFLIEGDLNPDNSDVDKLFIQ

LVQTYNQLFEENPINASGVDAKAILSARLSKSRRLENLIA

QLPGEKKNGLFGNLIALSLGLTPNFKSNFDLAEDAKLQLS

KDTYDDDLDNLLAQIGDQYADLFLAAKNLSDAILLSDILR

VNTEITKAPLSASMIKRYDEHHQDLTLLKALVRQQLPEK

YKEIFFDQSKNGYAGYIDGGASQEEFYKFIKPILEKMDGT
```

-continued

EELLVKLNREDLLRKQRTFDNGSIPHQIHLGELHAILRRQ

EDFYPFLKDNREKIEKILTFRIPYYVGPLARGNSRFAWMT

RKSEETITPWNFEEVVDKGASAQSFIERMTNFDKNLPNEK

VLPKHSLLYEYFTVYNELTKVKYVTEGMRKPAFLSGEQK

KAIVDLLFKTNRKVTVKQLKEDYFKKIECFDSVEISGVED

RFNASLGTYHDLLKIIKDKDFLDNEENEDILEDIVLTLTL

FEDREMIEERLKTYAHLFDDKVMKQLKRRRYTGWGRLSRK

LINGIRDKQSGKTILDFLKSDGFANRNFMQLIHDDSLTFK

EDIQKAQVSGQGDSLHEHIANLAGSPAIKKGILQTVKVVD

ELVKVMGRHKPENIVIEMARENQTTQKGQKNSRERMKRIE

EGIKELGSQILKEHPVENTQLQNEKLYLYYLQNGRDMYVD

QELDINRLSDYDVDHIVPQSFLKDDSIDNKVLTRSDKARG

KSDNVPSEEVVKKMKNYWRQLLNAKLITQRKFDNLTKAER

GGLSELDKAGFIKRQLVETRQITKHVAQILDSRMNTKYDE

NDKLIREVKVITLKSKLVSDFRKDFQFYKVREINNYHHAH

DAYLNAVVGTALIKKYPKLESEFVYGDYKVYDVRKMIAKS

EQEIGKATAKYFFYSNIMNFFKTEITLANGEIRKRPLIET

NGETGEIVWDKGRDFATVRKVLSMPQVNIVKKTEVQTGGF

SKESILPKRNSDKLIARKKDWDPKKYGGFDSPTVAYSVLV

VAKVEKGKSKKLKSVKELLGITIMERSSFEKNPIDFLEAK

GYKEVKKDLIIKLPKYSLFELENGRKRMLASAGELQKGNE

LALPSKYVNFLYLASHYEKLKGSPEDNEQKQLFVEQHKHY

LDEIIEQISEFSKRVILADANLDKVLSAYNKHRDKPIREQ

AENIIHLFTLTNLGAPAAFKYFDTTIDRKRYTSTKEVLDA

TLIHQSITGLYETRIDLSQLGGDGG

In some embodiments, a gene modifying polypeptide may comprise the amino acid sequence of SEQ ID NO: 4001 below, or a sequence having at least 70%, 75%, 80%, 85%, 90%, 95%, 96%, 97%, 98%, 99% identity thereto. In embodiments, the amino acid sequence of SEQ ID NO: 4001 below, or the sequence having at least 70%, 75%, 80%, 85%, 90%, 95%, 96%, 97%, 98%, 99% identity thereto, is positioned at the C-terminal end of the gene modifying polypeptide. In embodiments, the amino acid sequence of SEQ ID NO: 4001 below, or the sequence having at least 70%, 75%, 80%, 85%, 90%, 95%, 96%, 97%, 98%, 99% identity thereto, is positioned within 1, 2, 3, 4, 5, 6, 7, 8, 9, 10, 15, 20, 25, or 30 amino acids of the C-terminal end of the gene modifying polypeptide.

Exemplary C-terminal sequence comprising an NLS
(SEQ ID NO: 4001)
AGKRTADGSEFEKRTADGSEFESPKKKAKVE Exemplary benchmarking sequence
(SEQ ID NO: 4002)
MPAAKRVKLDGGDKKYSIGLDIGTNSVGWAVITDEYKVPS

KKFKVLGNTDRHSIKKNLIGALLFDSGETAEATRLKRTAR

RRYTRRKNRICYLQEIFSNEMAKVDDSFFHRLEESFLVEE

-continued

DKKHERHPIFGNIVDEVAYHEKYPTIYHLRKKLVDSTDKA

DLRLIYLALAHMIKFRGHFLIEGDLNPDNSDVDKLFIQLV

QTYNQLFEENPINASGVDAKAILSARLSKSRRLENLIAQL

PGEKKNGLFGNLIALSLGLTPNFKSNFDLAEDAKLQLSKD

TYDDDLDNLLAQIGDQYADLFLAAKNLSDAILLSDILRVN

TEITKAPLSASMIKRYDEHHQDLTLLKALVRQQLPEKYKE

IFFDQSKNGYAGYIDGGASQEEFYKFIKPILEKMDGTEEL

LVKLNREDLLRKQRTFDNGSIPHQIHLGELHAILRRQEDF

YPFLKDNREKIEKILTFRIPYYVGPLARGNSRFAWMTRKS

EETITPWNFEEVVDKGASAQSFIERMTNFDKNLPNEKVLP

KHSLLYEYFTVYNELTKVKYVTEGMRKPAFLSGEQKKAIV

DLLFKTNRKVTVKQLKEDYFKKIECFDSVEISGVEDRFNA

SLGTYHDLLKIIKDKDFLDNEENEDILEDIVLTLTLFEDR

EMIEERLKTYAHLFDDKVMKQLKRRRYTGWGRLSRKLING

IRDKQSGKTILDFLKSDGFANRNFMQLIHDDSLTFKEDIQ

KAQVSGQGDSLHEHIANLAGSPAIKKGILQTVKVVDELVK

VMGRHKPENIVIEMARENQTTQKGQKNSRERMKRIEEGIK

ELGSQILKEHPVENTQLQNEKLYLYYLQNGRDMYVDQELD

INRLSDYDVDHIVPQSFLKDDSIDNKVLTRSDKARGKSDN

VPSEEVVKKMKNYWRQLLNAKLITQRKFDNLTKAERGGLS

ELDKAGFIKRQLVETRQITKHVAQILDSRMNTKYDENDKL

IREVKVITLKSKLVSDFRKDFQFYKVREINNYHHAHDAYL

NAVVGTALIKKYPKLESEFVYGDYKVYDVRKMIAKSEQEI

GKATAKYFFYSNIMNFFKTEITLANGEIRKRPLIETNGET

GEIVWDKGRDFATVRKVLSMPQVNIVKKTEVQTGGFSKES

ILPKRNSDKLIARKKDWDPKKYGGFDSPTVAYSVLVVAKV

EKGKSKKLKSVKELLGITIMERSSFEKNPIDFLEAKGYKE

VKKDLIIKLPKYSLFELENGRKRMLASAGELQKGNELALP

SKYVNFLYLASHYEKLKGSPEDNEQKQLFVEQHKHYLDEI

IEQISEFSKRVILADANLDKVLSAYNKHRDKPIREQAENI

IHLFTLTNLGAPAAFKYFDTTIDRKRYTSTKEVLDATLIH

QSITGLYETRIDLSQLGGDGGSGGSSGGSSGSETPGTSES

ATPESSGGSSGGSSGGTLNIEDEYRLHETSKEPDVSLGST

WLSDFPQAWAETGGMGLAVRQAPLIIPLKATSTPVSIKQY

PMSQEARLGIKPHIQRLLDQGILVPCQSPWNTPLLPVKKP

GTNDYRPVQDLREVNKRVEDIHPTVPNPYNLLSGLPPSHQ

WYTVLDLKDAFFCLRLHPTSQPLFAFEWRDPEMGISGQLT

WTRLPQGFKNSPTLFNEALHRDLADFRIQHPDLILLQYVD

DLLLAATSELDCQQGTRALLQTLGNLGYRASAKKAQICQK

QVKYLGYLLKEGQRWLTEARKETVMGQPTPKTPRQLREFL

-continued

GKAGFCRLFIPGFAEMAAPLYPLTKPGTLFNWGPDQQKAY

QEIKQALLTAPALGLPDLTKPFELFVDEKQGYAKGVLTQK

LGPWRRPVAYLSKKLDPVAAGWPPCLRMVAAIAVLTKDAG

KLTMGQPLVILAPHAVEALVKQPPDRWLSNARMTHYQALL

LDTDRVQFGPVVALNPATLLPLPEEGLQHNCLDILAEAHG

TRPDLTDQPLPDADHTWYTDGSSLLQEGQRKAGAAVTTET

EVIWAKALPAGTSAQRAELIALTQALKMAEGKKLNVYTDS

-continued

RYAFATAHIHGEIYRRRGWLTSEGKEIKNKDEILALLKAL

FLPKRLSIIHCPGHQKGHSAEARGNRMADQAARKAAITET

PDTSTLLIENSSPSGGSKRTADGSEFEAGKRTADGSEFEK

RTADGSEFESPKKKAKVE

In some embodiments, a gene modifying polypeptide may comprise a Cas domain as listed in Table 7 or 8, or a functional fragment thereof, or a sequence having at least 70%, 75%, 80%, 85%, 90%, 95%, 96%, 97%, 98%, 99% identity thereto.

TABLE 7

CRISPR/Cas Proteins, Species, and Mutations

| Name | Enzyme | Species | # of AAs | PAM | Mutations to alter PAM recognition | Mutations to make catalytically dead |
|---|---|---|---|---|---|---|
| FnCas9 | Cas9 | *Francisella novicida* | 1629 | 5'-NGG-3' | Wt | D11A/H969A/N995A |
| FnCas9 RHA | Cas9 | *Francisella novicida* | 1629 | 5'-YG-3' | E1369R/E1449H/R1556A | D11A/H969A/N995A |
| SaCas9 | Cas9 | *Staphylococcus aureus* | 1053 | 5'-NNGRRT-3' | Wt | D10A/H557A |
| SaCas9 KKH | Cas9 | *Staphylococcus aureus* | 1053 | 5'-NNNRRT-3' | E782K/N968K/R1015H | D10A/H557A |
| SpCas9 | Cas9 | *Streptococcus pyogenes* | 1368 | 5'-NGG-3' | Wt | D10A/D839A/H840A/N863A |
| SpCas9 VQR | Cas9 | *Streptococcus pyogenes* | 1368 | 5'-NGA-3' | D1135V/R1335Q/T1337R | D10A/D839A/H840A/N863A |
| AsCpf1 RR | Cpf1 | *Acidaminococcus* sp. BV3L6 | 1307 | 5'-TYCV-3' | S542R/K607R | E993A |
| AsCpf1 RVR | Cpf1 | *Acidaminococcus* sp. BV3L6 | 1307 | 5'-TATV-3' | S542R/K548V/N552R | E993A |
| FnCpf1 | Cpf1 | *Francisella novicida* | 1300 | 5'-NTTN-3' | Wt | D917A/E1006A/D1255A |
| NmCas9 | Cas9 | *Neisseria meningitidis* | 1082 | 5'-NNNGATT-3' | Wt | D16A/D587A/H588A/N611A |

TABLE 8

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| Nme2Cas9 | *Neisseria meningitidis* | MAAFKPNPINYILGLDIGIASVGWAMVEIDEEENPIRLID LGVRVFERAEVPKTGDSLAMARRLARSVRRLTRRRAHRLL RARRLLKREGVLQAADFDENGLIKSLPNTPWQLRAAALDR KLTPLEWSAVLLHLIKHRGYLSQRKNEGETADKELGALLK GVANNAHALQTGDFRTPAELALNKFEKESGHIRNQRGDYS HTFSRKDLQAELILLFEKQKEFGNPHVSGGLKEGIETLLM TQRPALSGDAVQKMLGHCTFEPAEPKAAKNTYTAERFIWL TKLNNLRILEQGSERPLTDTERATLMDEPYRKSKLTYAQA RKLLGLEDTAFFKGLRYGKDNAEASTLMEMKAYHAISRAL EKEGLKDKKSPLNLSSELQDEIGTAFSLFKTDEDITGRLK DRVQPEILEALLKHISFDKFVQISLKALRRIVPLMEQGKR YDEACAEIYGDHYGKKNTEEKIYLPPIPADEIRNPVVLRA LSQARKVINGVVRRYGSPARIHIETAREVGKSFKDRKEIE KRQEENRKDREKAAAKFREYFPNFVGEPKSKDILKLRLYE | 9,001 | N611A | H588A | D16A |

TABLE 8-continued

| Amino Acid Sequences of CRISPR/ Cas Proteins, Species, and Mutations | | | | | | |
|---|---|---|---|---|---|---|
| Variant | Parental Host(s) | Protein Sequence | SEQ ID NO: | Nickase (HNH) | Nickase (HNH) | Nickase (RuvC) |
| | | QQHGKCLYSGKEINLVRLNEKGYVEIDHALPFSRTWDDSF<br>NNKVLVLGSENQNKGNQTPYEYFNGKDNSREWQEFKARVE<br>TSRFPRSKKQRILLQKFDEDGFKECNLNDTRYVNRFLCQF<br>VADHILLTGKGKRRVFASNGQITNLLRGFWGLRKVRAEND<br>RHHALDAVVVACSTVAMQQKITRFVRYKEMNAFDGKTIDK<br>ETGKVLHQKTHFPQPWEFFAQEVMIRVFGKPDGKPEFEEA<br>DTPEKLRTLLAEKLSSRPEAVHEYVTPLFVSRAPNRKMSG<br>AHKDTLRSAKRFVKHNEKISVKRVWLTEIKLADLENMVNY<br>KNGREIELYEALKARLEAYGGNAKQAFDPKDNPFYKKGGQ<br>LVKAVRVEKTQESGVLLNKKNAYTIADNGDMVRVDVFCKV<br>DKKGKNQYFIVPIYAWQVAENILPDIDCKGYRIDDSYTFC<br>FSLHKYDLIAFQKDEKSKVEFAYYINCDSSNGRFYLAWHD<br>KGSKEQQFRISTQNLVLIQKYQVNELGKEIRPCRLKKRPP<br>VR | | | | |
| PpnCas9 | *Pasteurella pneumotropica* | MQNNPLNYILGLDLGIASIGWAVVEIDEESSPIRLIDVGV<br>RTFERAEVAKTGESLALSRRLARSSRRLIKRRAERLKKAK<br>RLLKAEKILHSIDEKLPINVWQLRVKGLKEKLERQEWAAV<br>LLHLSKHRGYLSQRKNEGKSDNKELGALLSGIASNHQMLQ<br>SSEYRTPAEIAVKKFQVEEGHIRNQRGSYTHTFSRLDLLA<br>EMELLFQRQAELGNSYTSTTLLENLTALLMWQKPALAGDA<br>ILKMLGKCTFEPSEYKAAKNSYSAERFVWLTKLNNLRILE<br>NGTERALNDNERFALLEQPYEKSKLTYAQVRAMLALSDNA<br>IFKGVRYLGEDKKTVESKTTLIEMKFYHQIRKTLGSAELK<br>KEWNELKGNSDLLDEIGTAFSLYKTDDDICRYLEGKLPER<br>VLNALLENLNFDKFIQLSLKALHQILPLMLQGQRYDEAVS<br>AIYGDHYGKKSTETTRLLPTIPADEIRNPVVLRTLTQARK<br>VINAVVRLYGSPARIHIETAREVGKSYQDRKKLEKQQEDN<br>RKQRESAVKKFKEMFPHFVGEPKGKDILKMRLYELQQAKC<br>LYSGKSLELHRLLEKGYVEVDHALPFSRTWDDSFNNKVLV<br>LANENQNKGNLTPYEWLDGKNNSERWQHFVVRVQTSGFSY<br>AKKQRILNHKLDEKGFIERNLNDTRYVARFLCNFIADNML<br>LVGKGKRNVFASNGQITALLRHRWGLQKVREQNDRHHALD<br>AVVVACSTVAMQQKITRFVRYNEGNVFSGERIDRETGEII<br>PLHFPSPWAFFKENVEIRIFSENPKLELENRLPDYPQYNH<br>EWVQPLFVSRMPTRKMTGQGHMETVKSAKRLNEGLSVLKV<br>PLTQLKLSDLERMVNRDREIALYESLKARLEQFGNDPAKA<br>FAEPFYKKGGALVKAVRLEQTQKSGVLVRDGNGVADNASM<br>VRVDVFTKGGKYFLVPIYTWQVAKGILPNRAATQGKDEND<br>WDIMDEMATFQFSLCQNDLIKLVTKKKTIFGYFNGLNRAT<br>SNINIKEHDLDKSKGKLGIYLEVGVKLAISLEKYQVDELG<br>KNIRPCRPTKRQHVR | 9,002 | N605A | H582A | D13A |
| SauCas9 | *Staphylococcus aureus* | MKRNYILGLDIGITSVGYGIIDYETRDVIDAGVRLFKEAN<br>VENNEGRRSKRGARRLKRRRRHRIQRVKKLLFDYNLLTDH<br>SELSGINPYEARVKGLSQKLSEEEFSAALLHLAKRRGVHN<br>VNEVEEDTGNELSTKEQISRNSKALEEKYVAELQLERLKK<br>DGEVRGSINRFKTSDYVKEAKQLLKVQKAYHQLDQSFIDT<br>YIDLLETRRTYYEGPGEGSPFGWKDIKEWYEMLMGHCTYF<br>PEELRSVKYAYNADLYNALNDLNNLVITRDENEKLEYYEK<br>FQIIENVFKQKKKPTLKQIAKEILVNEEDIKGYRVTSTGK<br>PEFTNLKVYHDIKDITARKEIIENAELLDQIAKILTIYQS<br>SEDIQEELTNLNSELTQEEIEQISNLKGYTGTHNLSLKAI<br>NLILDELWHTNDNQIAIFNRLKLVPKKVDLSQQKEIPTTL<br>VDDFILSPVVKRSFIQSIKVINAIIKKYGLPNDIIIELAR<br>EKNSKDAQKMINEMQKRNRQTNERIEEIIRTTGKENAKYL<br>IEKIKLHDMQEGKCLYSLEAIPLEDLLNNPFNYEVDHIIP<br>RSVSFDNSFNNKVLVKQEENSKKGNRTPFQYLSSSDSKIS<br>YETFKKHILNLAKGKGRISKTKKEYLLEERDINRFSVQKD<br>FINRNLVDTRYATRGLMNLLRSYFRVNNLDVKVKSINGGF<br>TSFLRRKWKFKKERNKGYKHHAEDALIIANADFIFKEWKK<br>LDKAKKVMENQMFEEKQAESMPEIETEQEYKEIFITPHQI<br>KHIKDFKDYKYSHRVDKKPNRELINDTLYSTRKDDKGNTL<br>IVNNLNGLYDKDNDKLKKLINKSPEKLLMYHHDPQTYQKL<br>KLIMEQYGDEKNPLYKYYEETGNYLTKYSKKDNGPVIKKI<br>KYYGNKLNAHLDITDDYPNSRNKVVKLSLKPYRFDVYLDN<br>GVYKFVTVKNLDVIKKENYYEVNSKCYEEAKKLKKISNQA<br>EFIASFYNNDLIKINGELYRVIGVNNDLLNRIEVNMIDIT<br>YREYLENMNDKRPPRIIKTIASKTQSIKKYSTDILGNLYE<br>VKSKKHPQIIKKG | 9,003 | N580A | H557A | D10A |
| SauCas9-KKH | *Staphylococcus aureus* | MKRNYILGLDIGITSVGYGIIDYETRDVIDAGVRLFKEAN<br>VENNEGRRSKRGARRLKRRRRHRIQRVKKLLFDYNLLTDH<br>SELSGINPYEARVKGLSQKLSEEEFSAALLHLAKRRGVHN | 9,004 | N580A | H557A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | VNEVEEDTGNELSTKEQISRNSKALEEKYVAELQLERLKK<br>DGEVRGSINRFKTSDYVKEAKQLLKVQKAYHQLDQSFIDT<br>YIDLLETRRTYYEGPGEGSPFGWKDIKEWYEMLMGHCTYF<br>PEELRSVKYAYNADLYNALNDLNNLVITRDENEKLEYYEK<br>FQIIENVFKQKKKPTLKQIAKEILVNEEDIKGYRVTSTGK<br>PEFTNLKVYHDIKDITARKEIIENAELLDQIAKILTIYQS<br>SEDIQEELTNLNSELTQEEIEQISNLKGYTGTHNLSLKAI<br>NLILDELWHTNDNQIAIFNRLKLVPKKVDLSQQKEIPTTL<br>VDDFILSPVVKRSFIQSIKVINAIIKKYGLPNDIIIELAR<br>EKNSKDAQKMINEMQKRNRQTNERIEEIIRTTGKENAKYL<br>IEKIKLHDMQEGKCLYSLEAIPLEDLLNNPFNYEVDHIIP<br>RSVSFDNSFNNKVLVKQEENSKKGNRTPFQYLSSSDSKIS<br>YETFKKHILNLAKGKGRISKTKKEYLLEERDINRFSVQKD<br>FINRNLVDTRYATRGLMNLLRSYFRVNNLDVKVKSINGGF<br>TSFLRRKWKFKKERNKGYKHHAEDALIIANADFIFKEWKK<br>LDKAKKVMENQMFEEKQAESMPEIETEQEYKEIFITPHQI<br>KHIKDFKDYKYSHRVDKKPNRKLINDTLYSTRKDDKGNTL<br>IVNNLNGLYDKDNDKLKKLINKSPEKLLMYHHDPQTYQKL<br>KLIMEQYGDEKNPLYKYYEETGNYLTKYSKKDNGPVIKKI<br>KYYGNKLNAHLDITDDYPNSRNKVVKLSLKPYRFDVYLDN<br>GVYKFVTVKNLDVIKKENYYEVNSKCYEEAKKLKKISNQA<br>EFIASFYKNDLIKINGELYRVIGVNNDLLNRIEVNMIDIT<br>YREYLENMNDKRPPHIIKTIASKTQSIKKYSTDILGNLYE<br>VKSKKHPQIIKKG | | | | |
| SauriCas9 | *Staphylococcus auricularis* | MQENQQKQNYILGLDIGITSVGYGLIDSKTREVIDAGVRL<br>FPEADSENNSNRRSKRGARRLKRRRIHRLNRVKDLLADYQ<br>MIDLNNVPKSTDPYTIRVKGLREPLTKEEFAIALLHIAKR<br>RGLHNISVSMGDEEQDNELSTKQQLQKNAQQLQDKYVCEL<br>QLERLTNINKVRGEKNRFKTEDFVKEVKQLCETQRQYHNI<br>DDQFIQQYIDLVSTRREYFEGPGNGSPYGWDGDLLKWYEK<br>LMGRCTYFPEELRSVKYAYSADLFNALNDLNNLVVTRDDN<br>PKLEYYEKYHIIENVFKQKKNPTLKQIAKEIGVQDYDIRG<br>YRITKSGKPQFTSFKLYHDLKNIFEQAKYLEDVEMLDEIA<br>KILTIYQDEISIKKALDQLPELLTESEKSQIAQLTGYTGT<br>HRLSLKCIHIVIDELWESPENQMEIFTRLNLKPKKVEMSE<br>IDSIPTTLVDEFILSPVVKRAFIQSIKVINAVINRFGLPE<br>DIIIELAREKNSKDRRKFINKLQKQNEATRKKIEQLLAKY<br>GNTNAKYMIEKIKLHDMQEGKCLYSLEAIPLEDLLSNPTH<br>YEVDHIIPRSVSFDNSLNNKVLVKQSENSKKGNRTPYQYL<br>SSNESKISYNQFKQHILNLSKAKDRISKKKRDMLLEERDI<br>NKFEVQKEFINRNLVDTRYATRELSNLLKTYFSTHDYAVK<br>VKTINGGFTNHLRKVWDFKKHRNHGYKHHAEDALVIANAD<br>FLFKTHKALRRTDKILEQPGLEVNDTTVKVDTEEKYQELF<br>ETPKQVKNIKQFRDFKYSHRVDKKPNRQLINDTLYSTREI<br>DGETYVVQTLKDLYAKDNEKVKKLFTERPQKILMYQHDPK<br>TFEKLMTILNQYAEAKNPLAAYYEDKGEYVTKYAKKGNGP<br>AIHKIKYIDKKLGSYLDVSNKYPETQNKLVKLSLKSFRFD<br>IYKCEQGYKMVSIGYLDVLKKDNYYYIPKDKYEAEKQKKK<br>IKESDLFVGSFYYNDLIMYEDELFRVIGVNSDINNLVELN<br>MVDITYKDFCEVNNVTGEKRIKKTIGKRVVLIEKYTTDIL<br>GNLYKTPLPKKPQLIFKRGEL | 9,005 | N588A | H565A | D15A |
| SauriCas9-KKH | *Staphylococcus auricularis* | MQENQQKQNYILGLDIGITSVGYGLIDSKTREVIDAGVRL<br>FPEADSENNSNRRSKRGARRLKRRRIHRLNRVKDLLADYQ<br>MIDLNNVPKSTDPYTIRVKGLREPLTKEEFAIALLHIAKR<br>RGLHNISVSMGDEEQDNELSTKQQLQKNAQQLQDKYVCEL<br>QLERLTNINKVRGEKNRFKTEDFVKEVKQLCETQRQYHNI<br>DDQFIQQYIDLVSTRREYFEGPGNGSPYGWDGDLLKWYEK<br>LMGRCTYFPEELRSVKYAYSADLFNALNDLNNLVVTRDDN<br>PKLEYYEKYHIIENVFKQKKNPTLKQIAKEIGVQDYDIRG<br>YRITKSGKPQFTSFKLYHDLKNIFEQAKYLEDVEMLDEIA<br>KILTIYQDEISIKKALDQLPELLTESEKSQIAQLTGYTGT<br>HRLSLKCIHIVIDELWESPENQMEIFTRLNLKPKKVEMSE<br>IDSIPTTLVDEFILSPVVKRAFIQSIKVINAVINRFGLPE<br>DIIIELAREKNSKDRRKFINKLQKQNEATRKKIEQLLAKY<br>GNTNAKYMIEKIKLHDMQEGKCLYSLEAIPLEDLLSNPTH<br>YEVDHIIPRSVSFDNSLNNKVLVKQSENSKKGNRTPYQYL<br>SSNESKISYNQFKQHILNLSKAKDRISKKKRDMLLEERDI<br>NKFEVQKEFINRNLVDTRYATRELSNLLKTYFSTHDYAVK<br>VKTINGGFTNHLRKVWDFKKHRNHGYKHHAEDALVIANAD<br>FLFKTHKALRRTDKILEQPGLEVNDTTVKVDTEEKYQELF<br>ETPKQVKNIKQFRDFKYSHRVDKKPNRKLINDTLYSTREI<br>DGETYVVQTLKDLYAKDNEKVKKLFTERPQKILMYQHDPK | 9,006 | N588A | H565A | D15A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | TFEKLMTILNQYAEAKNPLAAYYEDKGEYVTKYAKKGNGP<br>AIHKIKYIDKKLGSYLDVSNKYPETQNKLVKLSLKSFRFD<br>IYKCEQGYKMVSIGYLDVLKKDNYYYIPKDKYEAEKQKKK<br>IKESDLFVGSFYKNDLIMYEDELFRVIGVNSDINNLVELN<br>MVDITYKDFCEVNNVTGEKHIKKTIGKRVVLIEKYTTDIL<br>GNLYKTPLPKKPQLIFKRGEL | | | | |
| ScaCas9-Sc++ | *Streptococcus canis* | MEKKYSIGLDIGTNSVGWAVITDDYKVPSKKFKVLGNTNR<br>KSIKKNLMGALLFDSGETAEATRLKRTARRRYTRRKNRIR<br>YLQEIFANEMAKLDDSFFQRLEESFLVEEDKKNERHPIFG<br>NLADEVAYHRNYPTIYHLRKKLADSPEKADLRLIYLALAH<br>IIKFRGHFLIEGKLNAENSDVAKLFYQLIQTYNQLFEESP<br>LDEIEVDAKGILSARLSKSKRLEKLIAVFPNEKKNGLFGN<br>IIALALGLTPNFKSNFDLTEDAKLQLSKDTYDDDLDELLG<br>QIGDQYADLFSAAKNLSDAILLSDILRSNSEVTKAPLSAS<br>MVKRYDEHHQDLALLKTLVRQQFPEKYAEIFKDDTKNGYA<br>GYVGADKKLRKRSGKLATEEEFYKFIKPILEKMDGAEELL<br>AKLNRDDLLRKQRTFDNGSIPHQIHLKELHAILRRQEEFY<br>PFLKENREKIEKILTFRIPYYVGPLARGNSRFAWLTRKSE<br>EAITPWNFEEVVDKGASAQSFIERMTNFDEQLPNKKVLPK<br>HSLLYEYFTVYNELTKVKYVTERMRKPEFLSGEQKKAIVD<br>LLFKTNRKVTVKQLKEDYFKKIECFDSVEIIGVEDRFNAS<br>LGTYHDLLKIIKDKDFLDNEENEDILEDIVLTLTLFEDRE<br>MIEERLKTYAHLFDDKVMKQLKRRHYTGWGRLSRKMINGI<br>RDKQSGKTILDFLKSDGFSNRNFMQLIHDDSLTFKEEIEK<br>AQVSGQGDSLHEQIADLAGSPAIKKGILQTVKIVDELVKV<br>MGHKPENIVIEMARENQTTTKGLQQSRERKKRIEEGIKEL<br>ESQILKENPVENTQLQNEKLYLYYLQNGRDMYVDQELDIN<br>RLSDYDVDHIVPQSFIKDDSIDNKVLTRSVENRGKSDNVP<br>SEEVVKKMKNYWRQLLNAKLITQRKFDNLTKAERGGLSEA<br>DKAGFIKRQLVETRQITKHVARILDSRMNTKRDKNDKPIR<br>EVKVITLKSKLVSDFRKDFQLYKVRDINNYHHAHDAYLNA<br>VVGTALIKKYPKLESEFVYGDYKVYDVRKMIAKSEQEIGK<br>ATAKRFFYSNIMNFFKTEVKLANGEIRKRPLIETNGETGE<br>VVWNKEKDFATVRKVLAMPQVNIVKKTEVQTGGFSKESIL<br>SKRESAKLIPRKKGWDTRKYGGFGSPTVAYSILVVAKVEK<br>GKAKKLKSVKVLVGITIMEKGSYEKDPIGFLEAKGYKDIK<br>KELIFKLPKYSLFELENGRRRMLASAKELQKANELVLPQH<br>LVRLLYYTQNISATTGSNNLGYIEQHREEFKEIFEKIIDF<br>SEKYILKNKVNSNLKSSFDEQFAVSDSILLSNSFVSLLKY<br>TSFGASGGFTFLDLDVKQGRLRYQTVTEVLDATLIYQSIT<br>GLYETRTDLSQLGGD | 9,007 | N872A | H849A | D10A |
| SpyCas9 | *Streptococcus pyogenes* | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MIKRYDEHHQDLTLLKALVRQQLPEKYKEIFFDQSKNGYA<br>GYIDGGASQEEFYKFIKPILEKMDGTEELLVKLNREDLLR<br>KQRTFDNGSIPHQIHLGELHAILRRQEDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRRRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGRHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEVQTGGFSKESILPKRNSDKLI<br>ARKKDWDPKKYGGFDSPTVAYSVLVVAKVEKGKSKKLKSV<br>KELLGITIMERSSFEKNPIDFLEAKGYKEVKKDLIIKLPK<br>YSLFELENGRKRMLASAGELQKGNELALPSKYVNFLYLAS | 9,008 | N863A | H840A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | HYEKLKGSPEDNEQKQLFVEQHKHYLDEIIEQISEFSKRV<br>ILADANLDKVLSAYNKHRDKPIREQAENIIHLFTLTNLGA<br>PAAFKYFDTTIDRKRYTSTKEVLDATLIHQSITGLYETRI<br>DLSQLGGD | | | | |
| SpyCas9-NG | *Streptococcus pyogenes* | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MIKRYDEHHQDLTLLKALVRQQLPEKYKEIFFDQSKNGYA<br>GYIDGGASQEEFYKFIKPILEKMDGTEELLVKLNREDLLR<br>KQRTFDNGSIPHQIHLGELHAILRRQEDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRRRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGRHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEVQTGGFSKESIRPKRNSDKLI<br>ARKKDWDPKKYGGFVSPTVAYSVLVVAKVEKGKSKKLKSV<br>KELLGITIMERSSFEKNPIDFLEAKGYKEVKKDLIIKLPK<br>YSLFELENGRKRMLASARFLQKGNELALPSKYVNFLYLAS<br>HYEKLKGSPEDNEQKQLFVEQHKHYLDEIIEQISEFSKRV<br>ILADANLDKVLSAYNKHRDKPIREQAENIIHLFTLTNLGA<br>PRAFKYFDTTIDRKVYRSTKEVLDATLIHQSITGLYETRI<br>DLSQLGGD | 9,009 | N863A | H840A | D10A |
| SpyCas9-SpRY | *Streptococcus pyogenes* | MDKKYSIGLDIGTNSVGWAVITDEYKVPSKKFKVLGNTDR<br>HSIKKNLIGALLFDSGETAERTRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MIKRYDEHHQDLTLLKALVRQQLPEKYKEIFFDQSKNGYA<br>GYIDGGASQEEFYKFIKPILEKMDGTEELLVKLNREDLLR<br>KQRTFDNGSIPHQIHLGELHAILRRQEDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRRRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGRHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEVQTGGFSKESIRPKRNSDKLI<br>ARKKDWDPKKYGGFLWPTVAYSVLVVAKVEKGKSKKLKSV<br>KELLGITIMERSSFEKNPIDFLEAKGYKEVKKDLIIKLPK | 9,010 | N863A | H840A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | YSLFELENGRKRMLASAKQLQKGNELALPSKYVNFLYLAS<br>HYEKLKGSPEDNEQKQLFVEQHKHYLDEIIEQISEFSKRV<br>ILADANLDKVLSAYNKHRDKPIREQAENIIHLFTLTRLGA<br>PRAFKYFDTTIDPKQYRSTKEVLDATLIHQSITGLYETRI<br>DLSQLGGD | | | | |
| St1Cas9 | *Streptococcus thermophilus* | MSDLVLGLDIGIGSVGVGILNKVTGEIIHKNSRIFPAAQA<br>ENNLVRRTNRQGRRLARRKKHRRVRLNRLFEESGLITDFT<br>KISINLNPYQLRVKGLTDELSNEELFIALKNMVKHRGISY<br>LDDASDDGNSSVGDYAQIVKENSKQLETKTPGQIQLERYQ<br>TYGQLRGDFTVEKDGKKHRLINVFPTSAYRSEALRILQTQ<br>QEFNPQITDEFINRYLEILTGKRKYYHGPGNEKSRTDYGR<br>YRTSGETLDNIFGILIGKCTFYPDEFRAAKASYTAQEFNL<br>LNDLNNLTVPTETKKLSKEQKNQIINYVKNEKAMGPAKLF<br>KYIAKLLSCDVADIKGYRIDKSGKAEIHTFEAYRKMKTLE<br>TLDIEQMDRETLDKLAYVLTLNTEREGIQEALEHEFADGS<br>FSQKQVDELVQFRKANSSIFGKGWHNFSVKLMMELIPELY<br>ETSEEQMTILTRLGKQKTTSSSNKTKYIDEKLLTEEIYNP<br>VVAKSVRQAIKIVNAAIKEYGDFDNIVIEMARETNEDDEK<br>KAIQKIQKANKDEKDAAMLKAANQYNGKAELPHSVFHGHK<br>QLATKIRLWHQQGERCLYTGKTISIHDLINNSNQFEVDHI<br>LPLSITFDDSLANKVLVYATANQEKGQRTPYQALDSMDDA<br>WSFRELKAFVRESKTLSNKKKEYLLTEEDISKFDVRKKFI<br>ERNLVDTRYASRVVLNALQEHFRAHKIDTKVSVVRGQFTS<br>QLRRHWGIEKTRDTYHHHAVDALIIAASSQLNLWKKQKNT<br>LVSYSEDQLLDIETGELISDDEYKESVFKAPYQHFVDTLK<br>SKEFEDSILFSYQVDSKFNRKISDATIYATRQAKVGKDKA<br>DETYVLGKIKDIYTQDGYDAFMKIYKKDKSKFLMYRHDPQ<br>TFEKVIEPILENYPNKQINEKGKEVPCNPFLKYKEEHGYI<br>RKYSKKGNGPEIKSLKYYDSKLGNHIDITPKDSNNKVVLQ<br>SVSPWRADVYFNKTTGKYEILGLKYADLQFEKGTGTYKIS<br>QEKYNDIKKKEGVDSDSEFKFTLYKNDLLLVKDTETKEQQ<br>LFRFLSRTMPKQKHYVELKPYDKQKFEGGEALIKVLGNVA<br>NSGQCKKGLGKSNISIYKVRTDVLGNQHIIKNEGDKPKLD<br>F | 9,011 | N622A | H599A | D9A |
| BlatCas9 | *Brevibacillus laterosporus* | MAYTMGIDVGIASCGWAIVDLERQRIIDIGVRTFEKAENP<br>KNGEALAVPRREARSSRRRLRRKKHRIERLKHMFVRNGLA<br>VDIQHLEQTLRSQNEIDVWQLRVDGLDRMLTQKEWLRVLI<br>HLAQRRGFQSNRKTDGSSEDGQVLVNVTENDRLMEEKDYR<br>TVAEMMVKDEKFSDHKRNKNGNYHGVVSRSSLLVEIHTLF<br>ETQRQHHNSLASKDFELEYVNIWSAQRPVATKDQIEKMIG<br>TCTFLPKEKRAPKASWHFQYFMLLQTINHIRITNVQGTRS<br>LNKEEIEQVVNMALTKSKVSYHDTRKILDLSEEYQFVGLD<br>YGKEDEKKKVESKETIIKLDDYHKLNKIFNEVELAKGETW<br>EADDYDTVAYALTFFKDDEDIRDYLQNKYKDSKNRLVKNL<br>ANKEYTNELIGKVSTLSFRKVGHLSLKALRKIIPFLEQGM<br>TYDKACQAAGFDFQGISKKKRSVVLPVIDQISNPVVNRAL<br>TQTRKVINALIKKYGSPETIHIETARELSKTFDERKNITK<br>DYKENRDKNEHAKKHLSELGIINPTGLDIVKYKLWCEQQG<br>RCMYSNQPISFERLKESGYTEVDHIIPYSRSMNDSYNNRV<br>LVMTRENREKGNQTPFEYMGNDTQRWYEFEQRVTTNPQIK<br>KEKRQNLLLKGFTNRRELEMLERNLNDTRYITKYLSHFIS<br>TNLEFSPSDKKKKVVNTSGRITSHLRSRWGLEKNRGQNDL<br>HHAMDAIVIAVTSDSFIQQVTNYYKRKERRELNGDDKFPL<br>PWKFFREEVIARLSPNPKEQIEALPNHFYSEDELADLQPI<br>FVSRMPKRSITGEAHQAQFRRVVGKTKEGKNITAKKTALV<br>DISYDKNGDFNMYGRETDPATYEAIKERYLEFGGNVKKAF<br>STDLHKPKKDGTKGPLIKSVRIMENKTLVHPVNKGKGVVY<br>NSSIVRTDVFQRKEKYYLLPVYVTDVTKGKLPNKVIVAKK<br>GYHDWIEVDDSFTFLFSLYPNDLIFIRQNPKKKISLKKRI<br>ESHSISDSKEVQEIHAYYKGVDSSTAAIEFIIHDGSYYAK<br>GVGVQNLDCFEKYQVDILGNYFKVKGEKRLELETSDSNHK<br>GKDVNSIKSTSR | 9,012 | N607A | H584A | D8A |
| cCas9-v16 | *Staphylococcus aureus* | MKRNYILGLDIGITSVGYGIIDYETRDVIDAGVRLFKEAN<br>VENNEGRRSKRGARRLKRRRRHRIQRVKKLLFDYNLLTDH<br>SELSGINPYEARVKGLSQKLSEEEFSAALLHLAKRRGVHN<br>VNEVEEDTGNELSTKEQISRNSKALEEKYVAELQLERLKK<br>DGEVRGSINRFKTSDYVKEAKQLLKVQKAYHQLDQSFIDT<br>YIDLLETRRTYYEGPGEGSPFGWKDIKEWYEMLMGHCTYF<br>PEELRSVKYAYNADLYNALNDLNNLVITRDENEKLEYYEK<br>FQIIENVFKQKKKPTLKQIAKEILVNEEDIKGYRVTSTGK<br>PEFTNLKVYHDIKDITARKEIIENAELLDQIAKILTIYQS | 9,013 | N580A | H557A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | SEDIQEELTNLNSELTQEEIEQISNLKGYTGTHNLSLKAI<br>NLILDELWHTNDNQIAIFNRLKLVPKKVDLSQQKEIPTTL<br>VDDFILSPVVKRSFIQSIKVINAIIKKYGLPNDIIIELAR<br>EKNSKDAQKMINEMQKRNRQTNERIEEIIRTTGKENAKYL<br>IEKIKLHDMQEGKCLYSLEAIPLEDLLNNPFNYEVDHIIP<br>RSVSFDNSFNNKVLVKQEENSKKGNRTPFQYLSSSDSKIS<br>YETFKKHILNLAKGKGRISKTKKEYLLEERDINRFSVQKD<br>FINRNLVDTRYATRGLMNLLRSYFRVNNLDVKVKSINGGF<br>TSFLRRKWKFKKERNKGYKHHAEDALIIANADFIFKEWKK<br>LDKAKKVMENQMFEEKQAESMPEIETEQEYKEIFITPHQI<br>KHIKDFKDYKYSHRVDKKPNRKLINDTLYSTRKDDKGNTL<br>IVNNLNGLYDKDNDKLKKLINKSPEKLLMYHHDPQTYQKL<br>KLIMEQYGDEKNPLYKYYEETGNYLTKYSKKDNGPVIKKI<br>KYYGNKLNAHLDITDDYPNSRNKVVKLSLKPYRFDVYLDN<br>GVYKFVTVKNLDVIKKENYYEVNSKCYEEAKKLKKISNQA<br>EFIASFYKNDLIKINGELYRVIGVNSDKNNLIEVNMIDIT<br>YREYLENMNDKRPPHIIKTIASKTQSIKKYSTDILGNLYE<br>VKSKKHPQIIKKG | | | | |
| cCas9-v17 | *Staphylococcus aureus* | MKRNYILGLDIGITSVGYGIIDYETRDVIDAGVRLFKEAN<br>VENNEGRRSKRGARRLKRRRRHRIQRVKKLLFDYNLLTDH<br>SELSGINPYEARVKGLSQKLSEEEFSAALLHLAKRRGVHN<br>VNEVEEDTGNELSTKEQISRNSKALEEKYVAELQLERLKK<br>DGEVRGSINRFKTSDYVKEAKQLLKVQKAYHQLDQSFIDT<br>YIDLLETRRTYYEGPGEGSPFGWKDIKEWYEMLMGHCTYF<br>PEELRSVKYAYNADLYNALNDLNNLVITRDENEKLEYYEK<br>FQIIENVFKQKKKPTLKQIAKEILVNEEDIKGYRVTSTGK<br>PEFTNLKVYHDIKDITARKEIIENAELLDQIAKILTIYQS<br>SEDIQEELTNLNSELTQEEIEQISNLKGYTGTHNLSLKAI<br>NLILDELWHTNDNQIAIFNRLKLVPKKVDLSQQKEIPTTL<br>VDDFILSPVVKRSFIQSIKVINAIIKKYGLPNDIIIELAR<br>EKNSKDAQKMINEMQKRNRQTNERIEEIIRTTGKENAKYL<br>IEKIKLHDMQEGKCLYSLEAIPLEDLLNNPFNYEVDHIIP<br>RSVSFDNSFNNKVLVKQEENSKKGNRTPFQYLSSSDSKIS<br>YETFKKHILNLAKGKGRISKTKKEYLLEERDINRFSVQKD<br>FINRNLVDTRYATRGLMNLLRSYFRVNNLDVKVKSINGGF<br>TSFLRRKWKFKKERNKGYKHHAEDALIIANADFIFKEWKK<br>LDKAKKVMENQMFEEKQAESMPEIETEQEYKEIFITPHQI<br>KHIKDFKDYKYSHRVDKKPNRKLINDTLYSTRKDDKGNTL<br>IVNNLNGLYDKDNDKLKKLINKSPEKLLMYHHDPQTYQKL<br>KLIMEQYGDEKNPLYKYYEETGNYLTKYSKKDNGPVIKKI<br>KYYGNKLNAHLDITDDYPNSRNKVVKLSLKPYRFDVYLDN<br>GVYKFVTVKNLDVIKKENYYEVNSKCYEEAKKLKKISNQA<br>EFIASFYKNDLIKINGELYRVIGVNNSTRNIVELNMIDIT<br>YREYLENMNDKRPPHIIKTIASKTQSIKKYSTDILGNLYE<br>VKSKKHPQIIKKG | 9,014 | N580A | H557A | D10A |
| cCas9-v21 | *Staphylococcus aureus* | MKRNYILGLDIGITSVGYGIIDYETRDVIDAGVRLFKEAN<br>VENNEGRRSKRGARRLKRRRRHRIQRVKKLLFDYNLLTDH<br>SELSGINPYEARVKGLSQKLSEEEFSAALLHLAKRRGVHN<br>VNEVEEDTGNELSTKEQISRNSKALEEKYVAELQLERLKK<br>DGEVRGSINRFKTSDYVKEAKQLLKVQKAYHQLDQSFIDT<br>YIDLLETRRTYYEGPGEGSPFGWKDIKEWYEMLMGHCTYF<br>PEELRSVKYAYNADLYNALNDLNNLVITRDENEKLEYYEK<br>FQIIENVFKQKKKPTLKQIAKEILVNEEDIKGYRVTSTGK<br>PEFTNLKVYHDIKDITARKEIIENAELLDQIAKILTIYQS<br>SEDIQEELTNLNSELTQEEIEQISNLKGYTGTHNLSLKAI<br>NLILDELWHTNDNQIAIFNRLKLVPKKVDLSQQKEIPTTL<br>VDDFILSPVVKRSFIQSIKVINAIIKKYGLPNDIIIELAR<br>EKNSKDAQKMINEMQKRNRQTNERIEEIIRTTGKENAKYL<br>IEKIKLHDMQEGKCLYSLEAIPLEDLLNNPFNYEVDHIIP<br>RSVSFDNSFNNKVLVKQEENSKKGNRTPFQYLSSSDSKIS<br>YETFKKHILNLAKGKGRISKTKKEYLLEERDINRFSVQKD<br>FINRNLVDTRYATRGLMNLLRSYFRVNNLDVKVKSINGGF<br>TSFLRRKWKFKKERNKGYKHHAEDALIIANADFIFKEWKK<br>LDKAKKVMENQMFEEKQAESMPEIETEQEYKEIFITPHQI<br>KHIKDFKDYKYSHRVDKKPNRKLINDTLYSTRKDDKGNTL<br>IVNNLNGLYDKDNDKLKKLINKSPEKLLMYHHDPQTYQKL<br>KLIMEQYGDEKNPLYKYYEETGNYLTKYSKKDNGPVIKKI<br>KYYGNKLNAHLDITDDYPNSRNKVVKLSLKPYRFDVYLDN<br>GVYKFVTVKNLDVIKKENYYEVNSKCYEEAKKLKKISNQA<br>EFIASFYKNDLIKINGELYRVIGVNSDDRNIIELNMIDIT<br>YREYLENMNDKRPPHIIKTIASKTQSIKKYSTDILGNLYE<br>VKSKKHPQIIKKG | 9,015 | N580A | H557A | D10A |

TABLE 8-continued

| Variant | Parental Host(s) | Protein Sequence | SEQ ID NO: | Nickase (HNH) | Nickase (HNH) | Nickase (RuvC) |
|---|---|---|---|---|---|---|
| Amino Acid Sequences of CRISPR/ Cas Proteins, Species, and Mutations | | | | | | |
| cCas9-v42 | *Staphylococcus aureus* | MKRNYILGLDIGITSVGYGIIDYETRDVIDAGVRLFKEAN VENNEGRRSKRGARRLKRRRRHRIQRVKKLLFDYNLLTDH SELSGINPYEARVKGLSQKLSEEEFSAALLHLAKRRGVHN VNEVEEDTGNELSTKEQISRNSKALEEKYVAELQLERLKK DGEVRGSINRFKTSDYVKEAKQLLKVQKAYHQLDQSFIDT YIDLLETRRTYYEGPGEGSPFGWKDIKEWYEMLMGHCTYF PEELRSVKYAYNADLYNALNDLNNLVITRDENEKLEYYEK FQIIENVFKQKKKPTLKQIAKEILVNEEDIKGYRVTSTGK PEFTNLKVYHDIKDITARKEIIENAELLDQIAKILTIYQS SEDIQEELTNLNSELTQEEIEQISNLKGYTGTHNLSLKAI NLILDELWHTNDNQIAIFNRLKLVPKKVDLSQQKEIPTTL VDDFILSPVVKRSFIQSIKVINAIIKKYGLPNDIIIELAR EKNSKDAQKMINEMQKRNRQTNERIEEIIRTTGKENAKYL IEKIKLHDMQEGKCLYSLEAIPLEDLLNNPFNYEVDHIIP RSVSFDNSFNNKVLVKQEENSKKGNRTPFQYLSSSDSKIS YETFKKHILNLAKGKGRISKTKKEYLLEERDINRFSVQKD FINRNLVDTRYATRGLMNLLRSYFRVNNLDVKVKSINGGF TSFLRRKWKFKKERNKGYKHHAEDALIIANADFIFKEWKK LDKAKKVMENQMFEEKQAESMPEIETEQEYKEIFITPHQI KHIKDFKDYKYSHRVDKKPNRKLINDTLYSTRKDDKGNTL IVNNLNGLYDKDNDKLKKLINKSPEKLLMYHHDPQTYQKL KLIMEQYGDEKNPLYKYYEETGNYLTKYSKKDNGPVIKKI KYYGNKLNAHLDITDDYPNSRNKVVKLSLKPYRFDVYLDN GVYKFVTVKNLDVIKKENYYEVNSKCYEEAKKLKKISNQA EFIASFYKNDLIKINGELYRVIGVNNNRLNKIELNMIDIT YREYLENMNDKRPPHIIKTIASKTQSIKKYSTDILGNLYE VKSKKHPQIIKKG | 9,016 | N580A | H557A | D10A |
| CdiCas9 | *Corynebacterium diphtheriae* | MKYHVGIDVGTFSVGLAAIEVDDAGMPIKTLSLVSHIHDS GLDPDEIKSAVTRLASSGIARRTRRLYRRKRRRLQQLDKF IQRQGWPVIELEDYSDPLYPWKVRAELAASYIADEKERGE KLSVALRHIARHRGWRNPYAKVSSLYLPDGPSDAFKAIRE EIKRASGQPVPETATVGQMVTLCELGTLKLRGEGGVLSAR LQQSDYAREIQEICRMQEIGQELYRKIIDVVFAAESPKG SASSRVGKDPLQPGKNRALKASDAFQRYRIAALIGNLRVR VDGEKRILSVEEKNLVFDHLVNLTPKKEPEWVTIAEILGI DRGQLIGTATMTDDGERAGARPPTHDTNRSIVNSRIAPLV DWWKTASALEQHAMVKALSNAEVDDFDSPEGAKVQAFFAD LDDDVHAKLDSLHLPVGRAAYSEDTLVRLTRRMLSDGVDL YTARLQEFGIEPSWTPPTPRIGEPVGNPAVDRVLKTVSRW LESATKTWGAPERVIIEHVREGFVTEKRAREMDGDMRRRA ARNAKLFQEMQEKLNVQGKPSRADLWRYQSVQRQNCQCAY CGSPITFSNSEMDHIVPRAGQGSTNTRENLVAVCHRCNQS KGNTPFAIWAKNTSIEGVSVKEAVERTRHWVTDTGMRSTD FKKFTKAVVERFQRATMDEEIDARSMESVAWMANELRSRV AQHFASHGTTVRVYRGSLTAEARRASGISGKLKFFDGVGK SRLDRRHHAIDAAVIAFTSDYVAETLAVRSNLKQSQAHRQ EAPQWREFTGKDAEHRAAWRVWCQKMEKLSALLTEDLRDD RVVVMSNVRLRLGNGSAHKETIGKLSKVKLSSQLSVSDID KASSEALWCALTREPGFDPKEGLPANPERHIRVNGTHVYA GDNIGLFPVSAGSIALRGGYAELGSSFHHARVYKITSGKK PAFAMLRVYTIDLLPYRNQDLFSVELKPQTMSMRQAEKKL RDALATGNAEYLGWLVVDDELVVDTSKIATDQVKAVEAEL GTIRRWRVDGFFSPSKLRLRPLQMSKEGIKKESAPELSKI IDRPGWLPAVNKLFSDGNVTVVRRDSLGRVRLESTAHLPV TWKVQ | 9,017 | N597A | H573A | D8A |
| CjeCas9 | *Campylobacter jejuni* | MARILAFDIGISSIGWAFSENDELKDCGVRIFTKVENPKT GESLALPRRLARSARKRLARRKARLNHLKHLIANEFKLNY EDYQSFDESLAKAYKGSLISPYELRFRALNELLSKQDFAR VILHIAKRRGYDDIKNSDDKEKGAILKAIKQNEEKLANYQ SVGEYLYKEYFQKFKENSKEFTNVRNKKESYERCIAQSFL KDELKLIFKKQREFGFSFSKKFEEEVLSVAFYKRALKDFS HLVGNCSFFTDEKRAPKNSPLAFMFVALTRIINLLNNLKN TEGILYTKDDLNALLNEVLKNGTLTYKQTKKLLGLSDDYE FKGEKGTYFIEFKKYKEFIKALGEHNLSQDDLNEIAKDIT LIKDEIKLKKALAKYDLNQNQIDSLSKLEFKDHLNISFKA LKLVTPLMLEGKKYDEACNELNLKVAINEDKKDFLPAFNE TYYKDEVTNPVVLRAIKEYRKVLNALLKKYGKVHKINIEL AREVGKNHSQRAKIEKEQNENYKAKKDAELECEKLGLKIN SKNILKLRLFKEQKEFCAYSGEKIKISDLQDEKMLEIDHI YPYSRSFDDSYMNKVLVFTKQNQEKLNQTPFEAFGNDSAK WQKIEVLAKNLPTKKQKRILDKNYKDKEQKNFKDRNLNDT | 9,018 | N582A | H559A | D8A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | RYIARLVLNYTKDYLDFLPLSDDENTKLNDTQKGSKVHVE<br>AKSGMLTSALRHTWGFSAKDRNNHLHHAIDAVIIAYANNS<br>IVKAFSDFKKEQESNSAELYAKKISELDYKNKRKFFEPFS<br>GFRQKVLDKIDEIFVSKPERKKPSGALHEETFRKEEEFYQ<br>SYGGKEGVLKALELGKIRKVNGKIVKNGDMFRVDIFKHKK<br>TNKFYAVPIYTMDFALKVLPNKAVARSKKGEIKDWILMDE<br>NYEFCFSLYKDSLILIQTKDMQEPEFVYYNAFTSSTVSLI<br>VSKHDNKFETLSKNQKILFKNANEKEVIAKSIGIQNLKVF<br>EKYIVSALGEVTKAEFRQREDFKK | | | | |
| GeoCas9 | *Geobacillus stearo-thermophilus* | MRYKIGLDIGITSVGWAVMNLDIPRIEDLGVRIFDRAENP<br>QTGESLALPRRLARSARRRLRRRKHRLERIRRLVIREGIL<br>TKEELDKLFEEKHEIDVWQLRVEALDRKLNNDELARVLLH<br>LAKRRGFKSNRKSERSNKENSTMLKHIEENRAILSSYRTV<br>GEMIVKDPKFALHKRNKGENYTNTIARDDLEREIRLIFSK<br>QREFGNMSCTEEFENEYITIWASQRPVASKDDIEKKVGFC<br>TFEPKEKRAPKATYTFQSFIAWEHINKLRLISPSGARGLT<br>DEERRLLYEQAFQKNKITYHDIRTLLHLPDDTYFKGIVYD<br>RGESRKQNENIRFLELDAYHQIRKAVDKVYGKGKSSSFLP<br>IDFDTFGYALTLFKDDADIHSYLRNEYEQNGKRMPNLANK<br>VYDNELIEELLNLSFTKFGHLSLKALRSILPYMEQGEVYS<br>SACERAGYTFTGPKKKQKTMLLPNIPPIANPVVMRALTQA<br>RKVVNAIIKKYGSPVSIHIELARDLSQTFDERRKTKKEQD<br>ENRKKNETAIRQLMEYGLTLNPTGHDIVKFKLWSEQNGRC<br>AYSLQPIEIERLLEPGYVEVDHVIPYSRSLDDSYTNKVLV<br>LTRENREKGNRIPAEYLGVGTERWQQFETFVLTNKQFSKK<br>KRDRLLRLHYDENEETEFKNRNLNDTRYISRFFANFIREH<br>LKFAESDDKQKVYTVNGRVTAHLRSRWEFNKNREESDLHH<br>AVDAVIVACTTPSDIAKVTAFYQRREQNKELAKKTEPHFP<br>QPWPHFADELRARLSKHPKESIKALNLGNYDDQKLESLQP<br>VFVSRMPKRSVTGAAHQETLRRYVGIDERSGKIQTVVKTK<br>LSEIKLDASGHFPMYGKESDPRTYEAIRQRLLEHNNDPKK<br>AFQEPLYKPKKNGEPGPVIRTVKIIDTKNQVIPLNDGKTV<br>AYNSNIVRVDVFEKDGKYYCVPVYTMDIMKGILPNKAIEP<br>NKPYSEWKEMTEDYTFRFSLYPNDLIRIELPREKTVKTAA<br>GEEINVKDVFVYYKTIDSANGGLELISHDHRFSLRGVGSR<br>TLKRFEKYQVDVLGNIYKVRGEKRVGLASSAHSKPGKTIR<br>PLQSTRD | 9,019 | N605A | H582A | D8A |
| iSpyMacCas9 | *Streptococcus* spp. | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRKLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MIKRYDEHHQDLTLLKALVRQQLPEKYKEIFFDQSKNGYA<br>GYIDGGASQEEFYKFIKPILEKMDGTEELLVKLKREDLLR<br>KQRTFDNGSIPHQIHLGELHAILRRQEDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRRRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGRHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEIQTVGQNGGLFDDNPKSPLEV<br>TPSKLVPLKKELNPKKYGGYQKPTTAYPVLLITDTKQLIP<br>ISVMNKKQFEQNPVKFLRDRGYQQVGKNDFIKLPKYTLVD<br>IGDGIKRLWASSKEIHKGNQLVVSKKSQILLYHAHHLDSD<br>LSNDYLQNHNQQFDVLFNEIISFSKKCKLGKEHIQKIENV<br>YSNKKNSASIEELAESFIKLLGFTQLGATSPFNFLGVKLN<br>QKQYKGKKDYILPCTEGTLIRQSITGLYETRVDLSKIGED<br>SGGSGGSKRTADGSEFES | 9,020 | N863A | H840A | D10A |

TABLE 8-continued

| Variant | Parental Host(s) | Protein Sequence | SEQ ID NO: | Nickase (HNH) | Nickase (HNH) | Nickase (RuvC) |
|---|---|---|---|---|---|---|
| Amino Acid Sequences of CRISPR/ Cas Proteins, Species, and Mutations | | | | | | |
| NmeCas9 | *Neisseria meningitidis* | MAAFKPNSINYILGLDIGIASVGWAMVEIDEEENPIRLID<br>LGVRVFERAEVPKTGDSLAMARRLARSVRRLTRRRAHRLL<br>RTRRLLKREGVLQAANFDENGLIKSLPNTPWQLRAAALDR<br>KLTPLEWSAVLLHLIKHRGYLSQRKNEGETADKELGALLK<br>GVAGNAHALQTGDFRTPAELALNKFEKESGHIRNQRSDYS<br>HTFSRKDLQAELILLFEKQKEFGNPHVSGGLKEGIETLLM<br>TQRPALSGDAVQKMLGHCTFEPAEPKAAKNTYTAERFIWL<br>TKLNNLRILEQGSERPLTDTERATLMDEPYRKSKLTYAQA<br>RKLLGLEDTAFFKGLRYGKDNAEASTLMEMKAYHAISRAL<br>EKEGLKDKKSPLNLSPELQDEIGTAFSLFKTDEDITGRLK<br>DRIQPEILEALLKHISFDKFVQISLKALRRIVPLMEQGKR<br>YDEACAEIYGDHYGKKNTEEKIYLPPIPADEIRNPVVLRA<br>LSQARKVINGVVRRYGSPARIHIETAREVGKSFKDRKEIE<br>KRQEENRKDREKAAAKFREYFPNFVGEPKSKDILKLRLYE<br>QQHGKCLYSGKEINLGRLNEKGYVEIDHALPFSRTWDDSF<br>NNKVLVLGSENQNKGNQTPYEYFNGKDNSREWQEFKARVE<br>TSRFPRSKKQRILLQKFDEDGFKERNLNDTRYVNRFLCQF<br>VADRMRLTGKGKKRVFASNGQITNLLRGFWGLRKVRAEND<br>RHHALDAVVVACSTVAMQQKITRFVRYKEMNAFDGKTIDK<br>ETGEVLHQKTHFPQPWEFFAQEVMIRVFGKPDGKPEFEEA<br>DTLEKLRTLLAEKLSSRPEAVHEYVTPLFVSRAPNRKMSG<br>QGHMETVKSAKRLDEGVSVLRVPLTQLKLKDLEKMVNRER<br>EPKLYEALKARLEAHKDDPAKAFAEPFYKYDKAGNRTQQV<br>KAVRVEQVQKTGVWVRNHNGIADNATMVRVDVFEKGDKYY<br>LVPIYSWQVAKGILPDRAVVQGKDEEDWQLIDDSFNFKFS<br>LHPNDLVEVITKKARMFGYFASCHRGTGNINIRIHDLDHK<br>IGKNGILEGIGVKTALSFQKYQIDELGKEIRPCRLKKRPP<br>VR | 9,021 | N611A | H588A | D16A |
| ScaCas9 | *Streptococcus canis* | MEKKYSIGLDIGTNSVGWAVITDDYKVPSKKFKVLGNTNR<br>KSIKKNLMGALLFDSGETAEATRLKRTARRRYTRRKNRIR<br>YLQEIFANEMAKLDDSFFQRLEESFLVEEDKKNERHPIFG<br>NLADEVAYHRNYPTIYHLRKKLADSPEKADLRLIYLALAH<br>IIKFRGHFLIEGKLNAENSDVAKLFYQLIQTYNQLFEESP<br>LDEIEVDAKGILSARLSKSKRLEKLIAVFPNEKKNGLFGN<br>IIALALGLTPNFKSNFDLTEDAKLQLSKDTYDDDLDELLG<br>QIGDQYADLFSAAKNLSDAILLSDILRSNSEVTKAPLSAS<br>MVKRYDEHHQDLALLKTLVRQQFPEKYAEIFKDDTKNGYA<br>GYVGIGIKHRKRTTKLATQEEFYKFIKPILEKMDGAEELL<br>AKLNRDDLLRKQRTFDNGSIPHQIHLKELHAILRRQEEFY<br>PFLKENREKIEKILTFRIPYYVGPLARGNSRFAWLTRKSE<br>EAITPWNFEEVVDKGASAQSFIERMTNFDEQLPNKKVLPK<br>HSLLYEYFTVYNELTKVKYVTERMRKPEFLSGEQKKAIVD<br>LLFKTNRKVTVKQLKEDYFKKIECFDSVEIIGVEDRFNAS<br>LGTYHDLLKIIKDKDFLDNEENEDILEDIVLTLTLFEDRE<br>MIEERLKTYAHLFDDKVMKQLKRRHYTGWGRLSRKMINGI<br>RDKQSGKTILDFLKSDGFSNRNFMQLIHDDSLTFKEEIEK<br>AQVSGQGDSLHEQIADLAGSPAIKKGILQTVKIVDELVKV<br>MGHKPENIVIEMARENQTTTKGLQQSRERKKRIEEGIKEL<br>ESQILKENPVENTQLQNEKLYLYYLQNGRDMYVDQELDIN<br>RLSDYDVDHIVPQSFIKDDSIDNKVLTRSVENRGKSDNVP<br>SEEVVKKMKNYWRQLLNAKLITQRKFDNLTKAERGGLSEA<br>DKAGFIKRQLVETRQITKHVARILDSRMNTKRDKNDKPIR<br>EVKVITLKSKLVSDFRKDFQLYKVRDINNYHHAHDAYLNA<br>VVGTALIKKYPKLESEFVYGDYKVYDVRKMIAKSEQEIGK<br>ATAKRFFYSNIMNFFKTEVKLANGEIRKRPLIETNGETGE<br>VVWNKEKDFATVRKVLAMPQVNIVKKTEVQTGGFSKESIL<br>SKRESAKLIPRKKGWDTRKYGGFGSPTVAYSILVVAKVEK<br>GKAKKLKSVKVLVGITIMEKGSYEKDPIGFLEAKGYKDIK<br>KELIFKLPKYSLFELENGRRRMLASATELQKANELVLPQH<br>LVRLLYYTQNISATTGSNNLGYIEQHREEFKEIFEKIIDF<br>SEKYILKNKVNSNLKSSFDEQFAVSDSILLSNSFVSLLKY<br>TSFGASGGFTFLDLDVKQGRLRYQTVTEVLDATLIYQSIT<br>GLYETRTDLSQLGGD | 9,022 | N872A | H849A | D10A |
| ScaCas9-HiFi-Sc++ | *Streptococcus canis* | MEKKYSIGLDIGTNSVGWAVITDDYKVPSKKFKVLGNTNR<br>KSIKKNLMGALLFDSGETAEATRLKRTARRRYTRRKNRIR<br>YLQEIFANEMAKLDDSFFQRLEESFLVEEDKKNERHPIFG<br>NLADEVAYHRNYPTIYHLRKKLADSPEKADLRLIYLALAH<br>IIKFRGHFLIEGKLNAENSDVAKLFYQLIQTYNQLFEESP<br>LDEIEVDAKGILSARLSKSKRLEKLIAVFPNEKKNGLFGN<br>IIALALGLTPNFKSNFDLTEDAKLQLSKDTYDDDLDELLG<br>QIGDQYADLFSAAKNLSDAILLSDILRSNSEVTKAPLSAS | 9,023 | N872A | H849A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | MVKRYDEHHQDLALLKTLVRQQFPEKYAEIFKDDTKNGYA<br>GYVGADKKLRKRSGKLATEEEFYKFIKPILEKMDGAEELL<br>AKLNRDDLLRKQRTFDNGSIPHQIHLKELHAILRRQEEFY<br>PFLKENREKIEKILTFRIPYYVGPLARGNSRFAWLTRKSE<br>EAITPWNFEEVVDKGASAQSFIERMTNFDEQLPNKKVLPK<br>HSLLYEYFTVYNELTKVKYVTERMRKPEFLSGEQKKAIVD<br>LLFKTNRKVTVKQLKEDYFKKIECFDSVEIIGVEDRFNAS<br>LGTYHDLLKIIKDKDFLDNEENEDILEDIVLTLTLFEDRE<br>MIEERLKTYAHLFDDKVMKQLKRRHYTGWGRLSRKMINGI<br>RDKQSGKTILDFLKSDGFSNANFMQLIHDDSLTFKEEIEK<br>AQVSGQGDSLHEQIADLAGSPAIKKGILQTVKIVDELVKV<br>MGHKPENIVIEMARENQTTTKGLQQSRERKKRIEEGIKEL<br>ESQILKENPVENTQLQNEKLYLYYLQNGRDMYVDQELDIN<br>RLSDYDVDHIVPQSFIKDDSIDNKVLTRSVENRGKSDNVP<br>SEEVVKKMKNYWRQLLNAKLITQRKFDNLTKAERGGLSEA<br>DKAGFIKRQLVETRQITKHVARILDSRMNTKRDKNDKPIR<br>EVKVITLKSKLVSDFRKDFQLYKVRDINNYHHAHDAYLNA<br>VVGTALIKKYPKLESEFVYGDYKVYDVRKMIAKSEQEIGK<br>ATAKRFFYSNIMNFFKTEVKLANGEIRKRPLIETNGETGE<br>VVWNKEKDFATVRKVLAMPQVNIVKKTEVQTGGFSKESIL<br>SKRESAKLIPRKKGWDTRKYGGFGSPTVAYSILVVAKVEK<br>GKAKKLKSVKVLVGITIMEKGSYEKDPIGFLEAKGYKDIK<br>KELIFKLPKYSLFELENGRRRMLASAKELQKANELVLPQH<br>LVRLLYYTQNISATTGSNNLGYIEQHREEFKEIFEKIIDF<br>SEKYILKNKVNSNLKSSFDEQFAVSDSILLSNSFVSLLKY<br>TSFGASGGFTFLDLDVKQGRLRYQTVTEVLDATLIYQSIT<br>GLYETRTDLSQLGGD | | | | |
| SpyCas9-3var-NRRH | *Streptococcus pyogenes* | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MVKRYDEHHQDLTLLKALVRQQLPEKYKEIFFDQSKNGYA<br>GYIDGGASQEEFYKFIKPILEKMDGTEELLVKLNREDLLR<br>KQRTFDNGIIPHQIHLGELHAILRRQGDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRLRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGGHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEVQTGGFSKESILPKGNSDKLI<br>ARKKDWDPKKYGGFNSPTAAYSVLVVAKVEKGKSKKLKSV<br>KELLGITIMERSSFEKNPIGFLEAKGYKEVKKDLIIKLPK<br>YSLFELENGRKRMLASAGVLHKGNELALPSKYVNFLYLAS<br>HYEKLKGSPEDNEQKQLFVEQHKHYLDEIIEQISEFSKRV<br>ILADANLDKVLSAYNKHRDKPIREQAENIIHLFTLTNLGV<br>PAAFKYFDTTIDKKRYTSTKEVLDATLIHQSITGLYETRI<br>DLSQLGGD | 9,024 | N863A | H840A | D10A |
| SpyCas9-3var-NRTH | *Streptococcus pyogenes* | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MVKRYDEHHQDLTLLKALVRQQLPEKYKEIFFDQSKNGYA<br>GYIDGGASQEEFYKFIKPILEKMDGTEELLVKLNREDLLR | 9,025 | N863A | H840A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | KQRTFDNGIIPHQIHLGELHAILRRQGDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRLRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGGHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEVQTGGFSKESILPKGNSDKLI<br>ARKKDWDPKKYGGFNSPTVAYSVLVVAKVEKGKSKKLKSV<br>KELLGITIMERSSFEKNPIGFLEAKGYKEVKKDLIIKLPK<br>YSLFELENGRKRMLASASVLHKGNELALPSKYVNFLYLAS<br>HYEKLKGSSEDNKQKQLFVEQHKHYLDEIIEQISEFSKRV<br>ILADANLDKVLSAYNKHRDKPIREQAENIIHLFTLTNLGA<br>SAAFKYFDTTIGRKLYTSTKEVLDATLIHQSITGLYETRI<br>DLSQLGGD | | | | |
| SpyCas9-3var-NRCH | *Streptococcus pyogenes* | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MVKRYDEHHQDLTLLKALVRQQLPEKYKEIFFDQSKNGYA<br>GYIDGGASQEEFYKFIKPILEKMDGTEELLVKLNREDLLR<br>KQRTFDNGIIPHQIHLGELHAILRRQGDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRLRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGGHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEVQTGGFSKESILPKGNSDKLI<br>ARKKDWDPKKYGGFNSPTVAYSVLVVAKVEKGKSKKLKSV<br>KELLGITIMERSSFEKNPIDFLEAKGYKEVKKDLIIKLPK<br>YSLFELENGRKRMLASAGVLQKGNELALPSKYVNFLYLAS<br>HYEKLKGSPEDNEQKQLFVEQHKHYLDEIIEQISEFSKRV<br>ILADANLDKVLSAYNKHRDKPIREQAENIIHLFTLTNLGA<br>PAAFKYFDTTINRKQYNTTKEVLDATLIRQSITGLYETRI<br>DLSQLGGD | 9,026 | N863A | H840A | D10A |
| SpyCas9-HF1 | *Streptococcus pyogenes* | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MIKRYDEHHQDLTLLKALVRQQLPEKYKEIFFDQSKNGYA<br>GYIDGGASQEEFYKFIKPILEKMDGTEELLVKLNREDLLR<br>KQRTFDNGSIPHQIHLGELHAILRRQEDFYPFLKDNREKI<br>EKILTFRIPYYVGPLARGNSRFAWMTRKSEETITPWNFEE | 9,027 | N863A | H840A | D10A |

TABLE 8-continued

| Amino Acid Sequences of CRISPR/ Cas Proteins, Species, and Mutations | | | | | | |
|---|---|---|---|---|---|---|
| Variant | Parental Host(s) | Protein Sequence | SEQ ID NO: | Nickase (HNH) | Nickase (HNH) | Nickase (RuvC) |
| | | VVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD | | | | |
| SpyCas9-QQR1 | *Streptococcus pyogenes* | MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADAQLDKVLSAYNKHRDKPIREQAENIIHLFTLTNLGAPAAFKYFDTTFKQKQYRSTKEVLDATLIHQSITGLYETRIDLSQLGGD | 9,028 | N863A | H840A | D10A |
| SpyCas9-SpG | *Streptococcus pyogenes* | MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPA | 9,029 | N863A | H840A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | FLSGEQKKAIVDLLFKTNRKVTVKQLKEDYFKKIECFDSV<br>EISGVEDRFNASLGTYHDLLKIIKDKDFLDNEENEDILED<br>IVLTLTLFEDREMIEERLKTYAHLFDDKVMKQLKRRRYTG<br>WGRLSRKLINGIRDKQSGKTILDFLKSDGFANRNFMQLIH<br>DDSLTFKEDIQKAQVSGQGDSLHEHIANLAGSPAIKKGIL<br>QTVKVVDELVKVMGRHKPENIVIEMARENQTTQKGQKNSR<br>ERMKRIEEGIKELGSQILKEHPVENTQLQNEKLYLYYLQN<br>GRDMYVDQELDINRLSDYDVDHIVPQSFLKDDSIDNKVLT<br>RSDKNRGKSDNVPSEEVVKKMKNYWRQLLNAKLITQRKFD<br>NLTKAERGGLSELDKAGFIKRQLVETRQITKHVAQILDSR<br>MNTKYDENDKLIREVKVITLKSKLVSDFRKDFQFYKVREI<br>NNYHHAHDAYLNAVVGTALIKKYPKLESEFVYGDYKVYDV<br>RKMIAKSEQEIGKATAKYFFYSNIMNFFKTEITLANGEIR<br>KRPLIETNGETGEIVWDKGRDFATVRKVLSMPQVNIVKKT<br>EVQTGGFSKESILPKRNSDKLIARKKDWDPKKYGGFLWPT<br>VAYSVLVVAKVEKGKSKKLKSVKELLGITIMERSSFEKNP<br>IDFLEAKGYKEVKKDLIIKLPKYSLFELENGRKRMLASAK<br>QLQKGNELALPSKYVNFLYLASHYEKLKGSPEDNEQKQLF<br>VEQHKHYLDEIIEQISEFSKRVILADANLDKVLSAYNKHR<br>DKPIREQAENIIHLFTLTNLGAPAAFKYFDTTIDRKQYRS<br>TKEVLDATLIHQSITGLYETRIDLSQLGGD | | | | |
| SpyCas9-VQR | *Streptococcus pyogenes* | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MIKRYDEHHQDLTLLKALVRQQLPEKYKEIFFDQSKNGYA<br>GYIDGGASQEEFYKFIKPILEKMDGTEELLVKLNREDLLR<br>KQRTFDNGSIPHQIHLGELHAILRRQEDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRRRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGRHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEVQTGGFSKESILPKRNSDKLI<br>ARKKDWDPKKYGGFVSPTVAYSVLVVAKVEKGKSKKLKSV<br>KELLGITIMERSSFEKNPIDFLEAKGYKEVKKDLIIKLPK<br>YSLFELENGRKRMLASAGELQKGNELALPSKYVNFLYLAS<br>HYEKLKGSPEDNEQKQLFVEQHKHYLDEIIEQISEFSKRV<br>ILADANLDKVLSAYNKHRDKPIREQAENIIHLFTLTNLGA<br>PAAFKYFDTTIDRKQYRSTKEVLDATLIHQSITGLYETRI<br>DLSQLGGD | 9,030 | N863A | H840A | D10A |
| SpyCas9-VRER | *Streptococcus pyogenes* | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MIKRYDEHHQDLTLLKALVRQQLPEKYKEIFFDQSKNGYA<br>GYIDGGASQEEFYKFIKPILEKMDGTEELLVKLNREDLLR<br>KQRTFDNGSIPHQIHLGELHAILRRQEDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA | 9,031 | N863A | H840A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | HLFDDKVMKQLKRRRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESILPKRNSDKLI ARKKDWDPKKYGGFVSPTVAYSVLVVAKVEKGKSKKLKSV KELLGITIMERSSFEKNPIDFLEAKGYKEVKKDLIIKLPK YSLFELENGRKRMLASARELQKGNELALPSKYVNFLYLAS HYEKLKGSPEDNEQKQLFVEQHKHYLDEIIEQISEFSKRV ILADANLDKVLSAYNKHRDKPIREQAENIIHLFTLTNLGA PAAFKYFDTTIDRKEYRSTKEVLDATLIHQSITGLYETRI DLSQLGGD | | | | |
| SpyCas9-xCas | *Streptococcus pyogenes* | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDTKLQLSKDTYDDDLDNLLA QIGDQYADLFLAAKNLSDAILLSDILRVNTEITKAPLSAS MIKLYDEHHQDLTLLKALVRQQLPEKYKEIFFDQSKNGYA GYIDGGASQEEFYKFIKPILEKMDGTEELLVKLNREDLLR KQRTFDNGIIPHQIHLGELHAILRRQEDFYPFLKDNREKI EKILTFRIPYYVGPLARGNSRFAWMTRKSEETITPWNFEK VVDKGASAQSFIERMTNFDKNLPNEKVLPKHSLLYEYFTV YNELTKVKYVTEGMRKPAFLSGDQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRRRYTGWGRLSRKLINGIRDKQSGKTIL DFLKSDGFANRNFIQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSF | 9,032 | N863A | H840A | D10A |
| SpyCas9-xCas-NG | *Streptococcus pyogenes* | LKDDSIDNKVLTRSDKNRGKSDNVPSEEVVKKMKNYWRQL LNAKLITQRKFDNLTKAERGGLSELDKAGFIKRQLVETRQ ITKHVAQILDSRMNTKYDENDKLIREVKVITLKSKLVSDF RKDFQFYKVREINNYHHAHDAYLNAVVGTALIKKYPKLES EFVYGDYKVYDVRKMIAKSEQEIGKATAKYFFYSNIMNFF KTEITLANGEIRKRPLIETNGETGEIVWDKGRDFATVRKV LSMPQVNIVKKTEVQTGGFSKESILPKRNSDKLIARKKDW DPKKYGGFDSPTVAYSVLVVAKVEKGKSKKLKSVKELLGI TIMERSSFEKNPIDFLEAKGYKEVKKDLIIKLPKYSLFEL ENGRKRMLASAGVLQKGNELALPSKYVNFLYLASHYEKLK GSPEDNEQKQLFVEQHKHYLDEIIEQISEFSKRVILADAN LDKVLSAYNKHRDKPIREQAENIIHLFTLTNLGAPAAFKY FDTTIDRKRYTSTKEVLDATLIHQSITGLYETRIDLSQLG GDMDKKYSIGLDIGTNSVGWAVITDEYKVPSKKFKVLGNT DRHSIKKNLIGALLFDSGETAEATRLKRTARRRYTRRKNR ICYLQEIFSNEMAKVDDSFFHRLEESFLVEEDKKHERHPI FGNIVDEVAYHEKYPTIYHLRKKLVDSTDKADLRLIYLAL AHMIKFRGHFLIEGDLNPDNSDVDKLFIQLVQTYNQLFEE NPINASGVDAKAILSARLSKSRRLENLIAQLPGEKKNGLF GNLIALSLGLTPNFKSNFDLAEDTKLQLSKDTYDDDLDNL LAQIGDQYADLFLAAKNLSDAILLSDILRVNTEITKAPLS ASMIKLYDEHHQDLTLLKALVRQQLPEKYKEIFFDQSKNG YAGYIDGGASQEEFYKFIKPILEKMDGTEELLVKLNREDL LRKQRTFDNGIIPHQIHLGELHAILRRQEDFYPFLKDNRE KIEKILTFRIPYYVGPLARGNSRFAWMTRKSEETITPWNF EKVVDKGASAQSFIERMTNFDKNLPNEKVLPKHSLLYEYF TVYNELTKVKYVTEGMRKPAFLSGDQKKAIVDLLFKTNRK VTVKQLKEDYFKKIECFDSVEISGVEDRFNASLGTYHDLL KIIKDKDFLDNEENEDILEDIVLTLTLFEDREMIEERLKT YAHLFDDKVMKQLKRRRYTGWGRLSRKLINGIRDKQSGKT ILDFLKSDGFANRNFIQLIHDDSLTFKEDIQKAQVSGQGD | 9,033 | N863A | H840A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | SLHEHIANLAGSPAIKKGILQTVKVVDELVKVMGRHKPEN<br>IVIEMARENQTTQKGQKNSRERMKRIEEGIKELGSQILKE<br>HPVENTQLQNEKLYLYYLQNGRDMYVDQELDINRLSDYDV<br>DHIVPQSFLKDDSIDNKVLTRSDKNRGKSDNVPSEEVVKK<br>MKNYWRQLLNAKLITQRKFDNLTKAERGGLSELDKAGFIK<br>RQLVETRQITKHVAQILDSRMNTKYDENDKLIREVKVITL<br>KSKLVSDFRKDFQFYKVREINNYHHAHDAYLNAVVGTALI<br>KKYPKLESEFVYGDYKVYDVRKMIAKSEQEIGKATAKYFF<br>YSNIMNFFKTEITLANGEIRKRPLIETNGETGEIVWDKGR<br>DFATVRKVLSMPQVNIVKKTEVQTGGFSKESIRPKRNSDK<br>LIARKKDWDPKKYGGFVSPTVAYSVLVVAKVEKGKSKKLK<br>SVKELLGITIMERSSFEKNPIDFLEAKGYKEVKKDLIIKL<br>PKYSLFELENGRKRMLASARFLQKGNELALPSKYVNFLYL<br>ASHYEKLKGSPEDNEQKQLFVEQHKHYLDEIIEQISEFSK<br>RVILADANLDKVLSAYNKHRDKPIREQAENIIHLFTLTNL<br>GAPRAFKYFDTTIDRKVYRSTKEVLDATLIHQSITGLYET<br>RIDLSQLGGD | | | | |
| St1Cas9-CNRZ1066 | *Streptococcus thermophilus* | MSDLVLGLDIGIGSVGVGILNKVTGEIIHKNSRIFPAAQA<br>ENNLVRRTNRQGRRLARRKKHRRVRLNRLFEESGLITDFT<br>KISINLNPYQLRVKGLTDELSNEELFIALKNMVKHRGISY<br>LDDASDDGNSSVGDYAQIVKENSKQLETKTPGQIQLERYQ<br>TYGQLRGDFTVEKDGKKHRLINVFPTSAYRSEALRILQTQ<br>QEFNPQITDEFINRYLEILTGKRKYYHGPGNEKSRTDYGR<br>YRTSGETLDNIFGILIGKCTFYPDEFRAAKASYTAQEFNL<br>LNDLNNLTVPTETKKLSKEQKNQIINYVKNEKAMGPAKLF<br>KYIAKLLSCDVADIKGYRIDKSGKAEIHTFEAYRKMKTLE<br>TLDIEQMDRETLDKLAYVLTLNTEREGIQEALEHEFADGS<br>FSQKQVDELVQFRKANSSIFGKGWHNFSVKLMMELIPELY<br>ETSEEQMTILTRLGKQKTTSSSNKTKYIDEKLLTEEIYNP<br>VVAKSVRQAIKIVNAAIKEYGDFDNIVIEMARETNEDDEK<br>KAIQKIQKANKDEKDAAMLKAANQYNGKAELPHSVFHGHK<br>QLATKIRLWHQQGERCLYTGKTISIHDLINNSNQFEVDHI<br>LPLSITFDDSLANKVLVYATANQEKGQRTPYQALDSMDDA<br>WSFRELKAFVRESKTLSNKKKEYLLTEEDISKFDVRKKFI<br>ERNLVDTRYASRVVLNALQEHFRAHKIDTKVSVVRGQFTS<br>QLRRHWGIEKTRDTYHHHAVDALIIAASSQLNLWKKQKNT<br>LVSYSEEQLLDIETGELISDDEYKESVFKAPYQHFVDTLK<br>SKEFEDSILFSYQVDSKFNRKISDATIYATRQAKVGKDKK<br>DETYVLGKIKDIYTQDGYDAFMKIYKKDKSKFLMYRHDPQ<br>TFEKVIEPILENYPNKQMNEKGKEVPCNPFLKYKEEHGYI<br>RKYSKKGNGPEIKSLKYYDSKLLGNPIDITPENSKNKVVL<br>QSLKPWRTDVYFNKATGKYEILGLKYADLQFEKGTGTYKI<br>SQEKYNDIKKKEGVDSDSEFKFTLYKNDLLLVKDTETKEQ<br>QLFRFLSRTLPKQKHYVELKPYDKQKFEGGEALIKVLGNV<br>ANGGQCIKGLAKSNISIYKVRTDVLGNQHIIKNEGDKPKL<br>DF | 9,034 | N622A | H599A | D9A |
| St1Cas9-LMG1831 | *Streptococcus thermophilus* | MSDLVLGLDIGIGSVGVGILNKVTGEIIHKNSRIFPAAQA<br>ENNLVRRTNRQGRRLARRKKHRRVRLNRLFEESGLITDFT<br>KISINLNPYQLRVKGLTDELSNEELFIALKNMVKHRGISY<br>LDDASDDGNSSVGDYAQIVKENSKQLETKTPGQIQLERYQ<br>TYGQLRGDFTVEKDGKKHRLINVFPTSAYRSEALRILQTQ<br>QEFNPQITDEFINRYLEILTGKRKYYHGPGNEKSRTDYGR<br>YRTSGETLDNIFGILIGKCTFYPDEFRAAKASYTAQEFNL<br>LNDLNNLTVPTETKKLSKEQKNQIINYVKNEKAMGPAKLF<br>KYIAKLLSCDVADIKGYRIDKSGKAEIHTFEAYRKMKTLE<br>TLDIEQMDRETLDKLAYVLTLNTEREGIQEALEHEFADGS<br>FSQKQVDELVQFRKANSSIFGKGWHNFSVKLMMELIPELY<br>ETSEEQMTILTRLGKQKTTSSSNKTKYIDEKLLTEEIYNP<br>VVAKSVRQAIKIVNAAIKEYGDFDNIVIEMARETNEDDEK<br>KAIQKIQKANKDEKDAAMLKAANQYNGKAELPHSVFHGHK<br>QLATKIRLWHQQGERCLYTGKTISIHDLINNSNQFEVDHI<br>LPLSITFDDSLANKVLVYATANQEKGQRTPYQALDSMDDA<br>WSFRELKAFVRESKTLSNKKKEYLLTEEDISKFDVRKKFI<br>ERNLVDTRYASRVVLNALQEHFRAHKIDTKVSVVRGQFTS<br>QLRRHWGIEKTRDTYHHHAVDALIIAASSQLNLWKKQKNT<br>LVSYSEEQLLDIETGELISDDEYKESVFKAPYQHFVDTLK<br>SKEFEDSILFSYQVDSKFNRKISDATIYATRQAKVGKDKK<br>DETYVLGKIKDIYTQDGYDAFMKIYKKDKSKFLMYRHDPQ<br>TFEKVIEPILENYPNKQMNEKGKEVPCNPFLKYKEEHGYI<br>RKYSKKGNGPEIKSLKYYDSKLLGNPIDITPENSKNKVVL<br>QSLKPWRTDVYFNKNTGKYEILGLKYADLQFEKKTGTYKI<br>SQEKYNGIMKEEGVDSDSEFKFTLYKNDLLLVKDTETKEQ | 9,035 | N622A | H599A | D9A |

TABLE 8-continued

| Amino Acid Sequences of CRISPR/ Cas Proteins, Species, and Mutations | | | | | | |
|---|---|---|---|---|---|---|
| Variant | Parental Host(s) | Protein Sequence | SEQ ID NO: | Nickase (HNH) | Nickase (HNH) | Nickase (RuvC) |
| | | QLFRFLSRTMPNVKYYVELKPYSKDKFEKNESLIEILGSA DKSGRCIKGLGKSNISIYKVRTDVLGNQHIIKNEGDKPKL DF | | | | |
| St1Cas9-MTH17CL396 | *Streptococcus thermophilus* | MSDLVLGLDIGIGSVGVGILNKVTGEIIHKNSRIFPAAQA ENNLVRRTNRQGRRLARRKKHRRVRLNRLFEESGLITDFT KISINLNPYQLRVKGLTDELSNEELFIALKNMVKHRGISY LDDASDDGNSSVGDYAQIVKENSKQLETKTPGQIQLERYQ TYGQLRGDFTVEKDGKKHRLINVFPTSAYRSEALRILQTQ QEFNPQITDEFINRYLEILTGKRKYYHGPGNEKSRTDYGR YRTSGETLDNIFGILIGKCTFYPDEFRAAKASYTAQEFNL LNDLNNLTVPTETKKLSKEQKNQIINYVKNEKAMGPAKLF KYIAKLLSCDVADIKGYRIDKSGKAEIHTFEAYRKMKTLE TLDIEQMDRETLDKLAYVLTLNTEREGIQEALEHEFADGS FSQKQVDELVQFRKANSSIFGKGWHNFSVKLMMELIPELY ETSEEQMTILTRLGKQKTTSSSNKTKYIDEKLLTEEIYNP VVAKSVRQAIKIVNAAIKEYGDFDNIVIEMARETNEDDEK KAIQKIQKANKDEKDAAMLKAANQYNGKAELPHSVFHGHK QLATKIRLWHQQGERCLYTGKTISIHDLINNSNQFEVDHI LPLSITFDDSLANKVLVYATANQEKGQRTPYQALDSMDDA WSFRELKAFVRESKTLSNKKKEYLLTEEDISKFDVRKKFI ERNLVDTRYASRVVLNALQEHFRAHKIDTKVSVVRGQFTS QLRRHWGIEKTRDTYHHHAVDALIIAASSQLNLWKKQKNT LVSYSEDQLLDIETGELISDDEYKESVFKAPYQHFVDTLK SKEFEDSILFSYQVDSKFNRKISDATIYATRQAKVGKDKA DETYVLGKIKDIYTQDGYDAFMKIYKKDKSKFLMYRHDPQ TFEKVIEPILENYPNKQINEKGKEVPCNPFLKYKEEHGYI RKYSKKGNGPEIKSLKYYDSKLGNHIDITPKDSNNKVVLQ SLKPWRTDVYFNKNTGKYEILGLKYSDMQFEKGTGKYSIS KEQYENIKVREGVDENSEFKFTLYKNDLLLLKDSENGEQI LLRFTSRNDTSKHYVELKPYNRQKFEGSEYLIKSLGTVAK GGQCIKGLGKSNISIYKVRTDVLGNQHIIKNEGDKPKLDF | 9,036 | N622A | H599A | D9A |
| St1Cas9-TH1477 | *Streptococcus thermophilus* | MSDLVLGLDIGIGSVGVGILNKVTGEIIHKNSRIFPAAQA ENNLVRRTNRQGRRLARRKKHRRVRLNRLFEESGLITDFT KISINLNPYQLRVKGLTDELSNEELFIALKNMVKHRGISY LDDASDDGNSSVGDYAQIVKENSKQLETKTPGQIQLERYQ TYGQLRGDFTVEKDGKKHRLINVFPTSAYRSEALRILQTQ QEFNPQITDEFINRYLEILTGKRKYYHGPGNEKSRTDYGR YRTSGETLDNIFGILIGKCTFYPDEFRAAKASYTAQEFNL LNDLNNLTVPTETKKLSKEQKNQIINYVKNEKAMGPAKLF KYIAKLLSCDVADIKGYRIDKSGKAEIHTFEAYRKMKTLE TLDIEQMDRETLDKLAYVLTLNTEREGIQEALEHEFADGS FSQKQVDELVQFRKANSSIFGKGWHNFSVKLMMELIPELY ETSEEQMTILTRLGKQKTTSSSNKTKYIDEKLLTEEIYNP VVAKSVRQAIKIVNAAIKEYGDFDNIVIEMARETNEDDEK KAIQKIQKANKDEKDAAMLKAANQYNGKAELPHSVFHGHK QLATKIRLWHQQGERCLYTGKTISIHDLINNSNQFEVDHI LPLSITFDDSLANKVLVYATANQEKGQRTPYQALDSMDDA WSFRELKAFVRESKTLSNKKKEYLLTEEDISKFDVRKKFI ERNLVDTRYASRVVLNALQEHFRAHKIDTKVSVVRGQFTS QLRRHWGIEKTRDTYHHHAVDALIIAASSQLNLWKKQKNT LVSYSEDQLLDIETGELISDDEYKESVFKAPYQHFVDTLK SKEFEDSILFSYQVDSKFNRKISDATIYATRQAKVGKDKA DETYVLGKIKDIYTQDGYDAFMKIYKKDKSKFLMYRHDPQ TFEKVIEPILENYPNKQINEKGKEVPCNPFLKYKEEHGYI RKYSKKGNGPEIKSLKYYDSKLGNHIDITPKDSNNKVVLQ SLKPWRTDVYFNKNTGKYEILGLKYSDMQFEKGTGKYSIS KEQYENIKVREGVDENSEFKFTLYKNDLLLLKDSENGEQI LLRFTSRNDTSKHYVELKPYNRQKFEGSEYLIKSLGTVVK GGRCIKGLGKSNISIYKVRTDVLGNQHIIKNEGDKPKLDF | 9,037 | N622A | H599A | D9A |
| SRGN3.1 | *Staphylococcus* spp. | MNQKFILGLDIGITSVGYGLIDYETKNIIDAGVRLFPEAN VENNEGRRSKRGSRRLKRRRIHRLERVKLLLTEYDLINKE QIPTSNNPYQIRVKGLSEILSKDELAIALLHLAKRRGIHN VDVAADKEETASDSLSTKDQINKNAKFLESRYVCELQKER LENEGHVRGVENRFLTKDIVREAKKIIDTQMQYYPEIDET FKEKYISLVETRREYFEGPGQGSPFGWNGDLKKWYEMLMG HCTYFPQELRSVKYAYSADLFNALNDLNNLIIQRDNSEKL EYHEKYHIIENVFKQKKKPTLKQIAKEIGVNPEDIKGYRI TKSGTPEFTSFKLFHDLKKVVKDHAILDDIDLLNQIAEIL TIYQDKDSIVAELGQLEYLMSEADKQSISELTGYTGTHSL SLKCMNMIIDELWHSSMNQMEVFTYLNMRPKKYELKGYQR IPTDMIDDAILSPVVKRTFIQSINVINKVIEKYGIPEDII | 9,038 | N585A | H562A | D10A |

TABLE 8-continued

Amino Acid Sequences of CRISPR/ Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | IELARENNSDDRKKFINNLQKKNEATRKRINEIIGQTGNQ NAKRIVEKIRLHDQQEGKCLYSLESIPLEDLLNNPNHYEV DHIIPRSVSFDNSYHNKVLVKQSENSKKSNLTPYQYFNSG KSKLSYNQFKQHILNLSKSQDRISKKKKEYLLEERDINKF EVQKEFINRNLVDTRYATRELTNYLKAYFSANNMNVKVKT INGSFTDYLRKVWKFKKERNHGYKHHAEDALIIANADFLF KENKKLKAVNSVLEKPEIETKQLDIQVDSEDNYSEMFIIP KQVQDIKDFRNFKYSHRVDKKPNRQLINDTLYSTRKKDNS TYIVQTIKDIYAKDNTTLKKQFDKSPEKFLMYQHDPRTFE KLEVIMKQYANEKNPLAKYHEETGEYLTKYSKKNNGPIVK SLKYIGNKLGSHLDVTHQFKSSTKKLVKLSIKNYRFDVYL TEKGYKFVTIAYLNVFKKDNYYYIPKDKYQELKEKKKIKD TDQFIASFYKNDLIKLNGDLYKIIGVNSDDRNIIELDYYD IKYKDYCEINNIKGEPRIKKTIGKKTESIEKFTTDVLGNL YLHSTEKAPQLIFKRGL | | | | |
| SRGN3.3 | *Staphylococcus* spp. | MNQKFILGLDIGITSVGYGLIDYETKNIIDAGVRLFPEAN VENNEGRRSKRGSRRLKRRRIHRLERVKLLLTEYDLINKE QIPTSNNPYQIRVKGLSEILSKDELAIALLHLAKRRGIHN VDVAADKEETASDSLSTKDQINKNAKFLESRYVCELQKER LENEGHVRGVENRFLTKDIVREAKKIIDTQMQYYPEIDET FKEKYISLVETRREYFEGPGQGSPFGWNGDLKKWYEMLMG HCTYFPQELRSVKYAYSADLFNALNDLNNLIIQRDNSEKL EYHEKYHIIENVFKQKKKPTLKQIAKEIGVNPEDIKGYRI TKSGTPEFTSFKLFHDLKKVVKDHAILDDIDLLNQIAEIL TIYQDKDSIVAELGQLEYLMSEADKQSISELTGYTGTHSL SLKCMNMIIDELWHSSMNQMEVFTYLNMRPKKYELKGYQR IPTDMIDDAILSPVVKRTFIQSINVINKVIEKYGIPEDII IELARENNSDDRKKFINNLQKKNEATRKRINEIIGQTGNQ NAKRIVEKIRLHDQQEGKCLYSLESIPLEDLLNNPNHYEV DHIIPRSVSFDNSYHNKVLVKQSENSKKSNLTPYQYFNSG KSKLSYNQFKQHILNLSKSQDRISKKKKEYLLEERDINKF EVQKEFINRNLVDTRYATRELTSYLKAYFSANNMDVKVKT INGSFTNHLRKVWRFDKYRNHGYKHHAEDALIIANADFLF KENKKLQNTNKILEKPTIENNTKKVTVEKEEDYNNVFETP KLVEDIKQYRDYKFSHRVDKKPNRQLINDTLYSTRMKDEH DYIVQTITDIYGKDNTNLKKQFNKNPEKFLMYQNDPKTFE KLSIIMKQYSDEKNPLAKYYEETGEYLTKYSKKNNGPIVK KIKLLGNKVGNHLDVTNKYENSTKKLVKLSIKNYRFDVYL TEKGYKFVTIAYLNVFKKDNYYYIPKDKYQELKEKKKIKD TDQFIASFYKNDLIKLNGDLYKIIGVNSDDRNIIELDYYD IKYKDYCEINNIKGEPRIKKTIGKKTESIEKFTTDVLGNL YLHSTEKAPQLIFKRGL | 9,039 | N585A | H562A | D10A |

In some embodiments, a Cas protein requires a protospacer adjacent motif (PAM) to be present in or adjacent to a target DNA sequence for the Cas protein to bind and/or function. In some embodiments, the PAM is or comprises, from 5' to 3', NGG, YG, NNGRRT, NNNRRT, NGA, TYCV, TATV, NTTN, or NNNGATT, where N stands for any nucleotide, Y stands for C or T, R stands for A or G, and V stands for A or C or G. In some embodiments, a Cas protein is a protein listed in Table 7 or 8. In some embodiments, a Cas protein comprises one or more mutations altering its PAM. In some embodiments, a Cas protein comprises E1369R, E1449H, and R1556A mutations or analogous substitutions to the amino acids corresponding to said positions. In some embodiments, a Cas protein comprises E782K, N968K, and R1015H mutations or analogous substitutions to the amino acids corresponding to said positions. In some embodiments, a Cas protein comprises D1135V, R1335Q, and T1337R mutations or analogous substitutions to the amino acids corresponding to said positions. In some embodiments, a Cas protein comprises S542R and K607R mutations or analogous substitutions to the amino acids corresponding to said positions. In some embodiments, a Cas protein comprises S542R, K548V, and N552R mutations or analogous substitutions to the amino acids corresponding to said positions. Exemplary advances in the engineering of Cas enzymes to recognize altered PAM sequences are reviewed in Collias et al Nature Communications 12:555 (2021), incorporated herein by reference in its entirety.

In some embodiments, the Cas protein is catalytically active and cuts one or both strands of the target DNA site. In some embodiments, cutting the target DNA site is followed by formation of an alteration, e.g., an insertion or deletion, e.g., by the cellular repair machinery.

In some embodiments, the Cas protein is modified to deactivate or partially deactivate the nuclease, e.g., nuclease-deficient Cas9. Whereas wild-type Cas9 generates double-strand breaks (DSBs) at specific DNA sequences targeted by a gRNA, a number of CRISPR endonucleases having modified functionalities are available, for example: a "nickase" version of Cas9 that has been partially deactivated generates only a single-strand break; a catalytically inactive Cas9 ("dCas9") does not cut target DNA. In some embodiments, dCas9 binding to a DNA sequence may interfere with transcription at that site by steric hindrance. In some embodiments, dCas9 binding to an anchor sequence may interfere with (e.g., decrease or prevent) genomic complex (e.g., ASMC) formation and/or maintenance. In some embodiments, a DNA-binding domain comprises a catalytically inactive Cas9, e.g., dCas9. Many catalytically inactive Cas9 proteins are known in the art. In some embodiments, dCas9 comprises mutations in each endonuclease domain of the Cas protein, e.g., D10A and H840A or N863A mutations. In some embodiments, a catalytically inactive or partially inactive CRISPR/Cas domain comprises a Cas protein comprising one or more mutations, e.g., one or more of the mutations listed in Table 7. In some embodiments, a Cas protein described on a given row of Table 7 comprises one, two, three, or all of the mutations listed in the same row of Table 7. In some embodiments, a Cas protein, e.g., not described in Table 7, comprises one, two, three, or all of the mutations listed in a row of Table 7 or a corresponding mutation at a corresponding site in that Cas protein.

In some embodiments, a catalytically inactive, e.g., dCas9, or partially deactivated Cas9 protein comprises a D11 mutation (e.g., D11A mutation) or an analogous substitution to the amino acid corresponding to said position. In some embodiments, a catalytically inactive Cas9 protein, e.g., dCas9, or partially deactivated Cas9 protein comprises a H969 mutation (e.g., H969A mutation) or an analogous substitution to the amino acid corresponding to said position. In some embodiments, a catalytically inactive Cas9 protein, e.g., dCas9, or partially deactivated Cas9 protein comprises a N995 mutation (e.g., N995A mutation) or an analogous substitution to the amino acid corresponding to said position. In some embodiments, a catalytically inactive Cas9 protein, e.g., dCas9, comprises mutations at one, two, or three of positions D11, H969, and N995 (e.g., D11A, H969A, and N995A mutations) or analogous substitutions to the amino acids corresponding to said positions.

In some embodiments, a catalytically inactive Cas9 protein, e.g., dCas9, or partially deactivated Cas9 protein comprises a D10 mutation (e.g., a D10A mutation) or an analogous substitution to the amino acid corresponding to said position. In some embodiments, a catalytically inactive Cas9 protein, e.g., dCas9, or partially deactivated Cas9 protein comprises a H557 mutation (e.g., a H557A mutation) or an analogous substitution to the amino acid corresponding to said position. In some embodiments, a catalytically inactive Cas9 protein, e.g., dCas9, comprises a D10 mutation (e.g., a D10A mutation) and a H557 mutation (e.g., a H557A mutation) or analogous substitutions to the amino acids corresponding to said positions.

In some embodiments, a catalytically inactive Cas9 protein, e.g., dCas9, or partially deactivated Cas9 protein comprises a D839 mutation (e.g., a D839A mutation) or an analogous substitution to the amino acid corresponding to said position. In some embodiments, a catalytically inactive Cas9 protein, e.g., dCas9, or partially deactivated Cas9 protein comprises a H840 mutation (e.g., a H840A mutation) or an analogous substitution to the amino acid corresponding to said position. In some embodiments, a catalytically inactive Cas9 protein, e.g., dCas9, or partially deactivated Cas9 protein comprises a N863 mutation (e.g., a N863A mutation) or an analogous substitution to the amino acid corresponding to said position. In some embodiments, a catalytically inactive Cas9 protein, e.g., dCas9, comprises a D10 mutation (e.g., D10A), a D839 mutation (e.g., D839A), a H840 mutation (e.g., H840A), and a N863 mutation (e.g., N863A) or analogous substitutions to the amino acids corresponding to said positions.

In some embodiments, a catalytically inactive Cas9 protein, e.g., dCas9, or partially deactivated Cas9 protein comprises a E993 mutation (e.g., a E993A mutation) or an analogous substitution to the amino acid corresponding to said position.

In some embodiments, a catalytically inactive Cas9 protein, e.g., dCas9, or partially deactivated Cas9 protein comprises a D917 mutation (e.g., a D917A mutation) or an analogous substitution to the amino acid corresponding to said position. In some embodiments, a catalytically inactive Cas9 protein, e.g., dCas9, or partially deactivated Cas9 protein comprises a a E1006 mutation (e.g., a E1006A mutation) or an analogous substitution to the amino acid corresponding to said position. In some embodiments, a catalytically inactive Cas9 protein, e.g., dCas9, or partially deactivated Cas9 protein comprises a D1255 mutation (e.g., a D1255A mutation) or an analogous substitution to the amino acid corresponding to said position. In some embodiments, a catalytically inactive Cas9 protein, e.g., dCas9, comprises a D917 mutation (e.g., D917A), a E1006 mutation (e.g., E1006A), and a D1255 mutation (e.g., D1255A) or analogous substitutions to the amino acids corresponding to said positions.

In some embodiments, a catalytically inactive Cas9 protein, e.g., dCas9, or partially deactivated Cas9 protein comprises a D16 mutation (e.g., a D16A mutation) or an analogous substitution to the amino acid corresponding to said position. In some embodiments, a catalytically inactive Cas9 protein, e.g., dCas9, or partially deactivated Cas9 protein comprises a D587 mutation (e.g., a D587A mutation) or an analogous substitution to the amino acid corresponding to said position. In some embodiments, a partially deactivated Cas domain has nickase activity. In some embodiments, a partially deactivated Cas9 domain is a Cas9 nickase domain. In some embodiments, the catalytically inactive Cas domain or dead Cas domain produces no detectable double strand break formation. In some embodiments, a catalytically inactive Cas9 protein, e.g., dCas9, or partially deactivated Cas9 protein comprises a H588 mutation (e.g., a H588A mutation) or an analogous substitution to the amino acid corresponding to said position. In some embodiments, a catalytically inactive Cas9 protein, e.g., dCas9, or partially deactivated Cas9 protein comprises a N611 mutation (e.g., a N611A mutation) or an analogous substitution to the amino acid corresponding to said position. In some embodiments, a catalytically inactive Cas9 protein, e.g., dCas9, comprises a D16 mutation (e.g., D16A), a D587 mutation (e.g., D587A), a H588 mutation (e.g., H588A), and a N611 mutation (e.g., N611A) or analogous substitutions to the amino acids corresponding to said positions.

In some embodiments, a DNA-binding domain or endonuclease domain may comprise a Cas molecule comprising or linked (e.g., covalently) to a gRNA (e.g., a template nucleic acid, e.g., template RNA, comprising a gRNA).

In some embodiments, an endonuclease domain or DNA binding domain comprises a *Streptococcus pyogenes* Cas9 (SpCas9) or a functional fragment or variant thereof. In some embodiments, the endonuclease domain or DNA binding domain comprises a modified SpCas9. In embodiments, the modified SpCas9 comprises a modification that alters protospacer-adjacent motif (PAM) specificity. In embodiments, the PAM has specificity for the nucleic acid sequence 5'-NGT-3'. In embodiments, the modified SpCas9 comprises one or more amino acid substitutions, e.g., at one or more of positions L1111, D1135, G1218, E1219, A1322, of R1335, e.g., selected from L1111R, D1135V, G1218R, E1219F, A1322R, R1335V. In embodiments, the modified SpCas9 comprises the amino acid substitution T1337R and one or more additional amino acid substitutions, e.g., selected from L1111, D1135L, S1136R, G1218S, E1219V, D1332A, D1332S, D1332T, D1332V, D1332L, D1332K, D1332R, R1335Q, T1337, T1337L, T1337Q, T1337I, T1337V, T1337F, T1337S, T1337N, T1337K, T1337H, T1337Q, and T1337M, or corresponding amino acid substitutions thereto. In embodiments, the modified SpCas9 comprises: (i) one or more amino acid substitutions selected from D1135L, S1136R, G1218S, E1219V, A1322R, R1335Q, and T1337; and (ii) one or more amino acid substitutions selected from L1111R, G1218R, E1219F, D1332A, D1332S, D1332T, D1332V, D1332L, D1332K, D1332R, T1337L, T1337I, T1337V, T1337F, T1337S, T1337N, T1337K, T1337R, T1337H, T1337Q, and T1337M, or corresponding amino acid substitutions thereto.

In some embodiments, the endonuclease domain or DNA binding domain comprises a Cas domain, e.g., a Cas9 domain. In embodiments, the endonuclease domain or DNA binding domain comprises a nuclease-active Cas domain, a Cas nickase (nCas) domain, or a nuclease-inactive Cas (dCas) domain. In embodiments, the endonuclease domain or DNA binding domain comprises a nuclease-active Cas9 domain, a Cas9 nickase (nCas9) domain, or a nuclease-inactive Cas9 (dCas9) domain. In some embodiments, the endonuclease domain or DNA binding domain comprises a Cas9 domain of Cas9 (e.g., dCas9 and nCas9), Cas12a/Cpf1, Cas12b/C2c1, Cas12c/C2c3, Cas12d/CasY, Cas12e/CasX, Cas12g, Cas12h, or Cas12i. In some embodiments, the endonuclease domain or DNA binding domain comprises a Cas9 (e.g., dCas9 and nCas9), Cas12a/Cpf1, Cas12b/C2c1, Cas12c/C2c3, Cas12d/CasY, Cas12e/CasX, Cas12g, Cas12h, or Cas12i. In some embodiments, the endonuclease domain or DNA binding domain comprises an *S. pyogenes* or an *S. thermophilus* Cas9, or a functional fragment thereof. In some embodiments, the endonuclease domain or DNA binding domain comprises a Cas9 sequence, e.g., as described in Chylinski, Rhun, and Charpentier (2013) RNA Biology 10:5, 726-737; incorporated herein by reference. In some embodiments, the endonuclease domain or DNA binding domain comprises the HNH nuclease subdomain and/or the RuvC1 subdomain of a Cas, e.g., Cas9, e.g., as described herein, or a variant thereof. In some embodiments, the endonuclease domain or DNA binding domain comprises Cas12a/Cpf1, Cas12b/C2c1, Cas12c/C2c3, Cas12d/CasY, Cas12e/CasX, Cas12g, Cas12h, or Cas12i. In some embodiments, the endonuclease domain or DNA binding domain comprises a Cas polypeptide (e.g., enzyme), or a functional fragment thereof. In embodiments, the Cas polypeptide (e.g., enzyme) is selected from Cas1, Cas1B, Cas2, Cas3, Cas4, Cas5, Cas5d, Cas5t, Cas5h, Cas5a, Cash, Cas7, Cas8, Cas8a, Cas8b, Cas8c, Cas9 (e.g., Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, Cpf1, Cas12b/C2c1, Cas12c/C2c3, Cas12b/C2c1, Cas12c/C2c3, SpCas9 (K855A), eSpCas9(1.1), SpCas9-HF1, hyper accurate Cas9 variant (HypaCas9), homologues thereof, modified or engineered versions thereof, and/or functional fragments thereof. In embodiments, the Cas9 comprises one or more substitutions, e.g., selected from H840A, D10A, P475A, W476A, N477A, D1125A, W1126A, and D1127A. In embodiments, the Cas9 comprises one or more mutations at positions selected from: D10, G12, G17, E762, H840, N854, N863, H982, H983, A984, D986, and/or A987, e.g., one or more substitutions selected from D10A, G12A, G17A, E762A, H840A, N854A, N863A, H982A, H983A, A984A, and/or D986A. In some embodiments, the endonuclease domain or DNA binding domain comprises a Cas (e.g., Cas9) sequence from *Corynebacterium ulcerans, Corynebacterium diphtheria, Spiroplasma syrphidicola, Prevotella intermedia, Spiroplasma taiwanense, Streptococcus iniae, Belliella baltica, Psychroflexus torquis, Streptococcus thermophilus, Listeria innocua, Campylobacter jejuni, Neisseria meningitidis, Streptococcus pyogenes*, or *Staphylococcus aureus*, or a fragment or variant thereof.

In some embodiments, the endonuclease domain or DNA binding domain comprises a Cpf1 domain, e.g., comprising one or more substitutions, e.g., at position D917, E1006A, D1255 or any combination thereof, e.g., selected from D917A, E1006A, D1255A, D917A/E1006A, D917A/D1255A, E1006A/D1255A, and D917A/E1006A/D1255A.

In some embodiments, the endonuclease domain or DNA binding domain comprises spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, a gene modifying polypeptide has an endonuclease domain comprising a Cas9 nickase, e.g., Cas9 H840A. In embodiments, the Cas9 H840A has the following amino acid sequence:

```
Cas9 nickase (H840A):
                                     (SEQ ID NO: 11,001)
DKKYSIGLDIGTNSVGWAVITDEYKVPSKKFKVLGNTDRHS

IKKNLIGALLFDSGETAEATRLKRTARRRYTRRKNRICYL

QEIFSNEMAKVDDSFFHRLEESFLVEEDKKHERHPIFGNI

VDEVAYHEKYPTIYHLRKKLVDSTDKADLRLIYLALAHMI

KFRGHFLIEGDLNPDNSDVDKLFIQLVQTYNQLFEENPIN

ASGVDAKAILSARLSKSRRLENLIAQLPGEKKNGLFGNLI

ALSLGLTPNFKSNFDLAEDAKLQLSKDTYDDDLDNLLAQI

GDQYADLFLAAKNLSDAILLSDILRVNTEITKAPLSASMI

KRYDEHHQDLTLLKALVRQQLPEKYKEIFFDQSKNGYAGY

IDGGASQEEFYKFIKPILEKMDGTEELLVKLNREDLLRKQ

RTFDNGSIPHQIHLGELHAILRRQEDFYPFLKDNREKIEK

ILTFRIPYYVGPLARGNSRFAWMTRKSEETITPWNFEEVV

DKGASAQSFIERMTNFDKNLPNEKVLPKHSLLYEYFTVYN

ELTKVKYVTEGMRKPAFLSGEQKKAIVDLLFKTNRKVTVK

QLKEDYFKKIECFDSVEISGVEDRFNASLGTYHDLLKIIK

DKDFLDNEENEDILEDIVLTLTLFEDREMIEERLKTYAHL

FDDKVMKQLKRRRYTGWGRLSRKLINGIRDKQSGKTILDF

LKSDGFANRNFMQLIHDDSLTFKEDIQKAQVSGQGDSLHE

HIANLAGSPAIKKGILQTVKVVDELVKVMGRHKPENIVIE

MARENQTTQKGQKNSRERMKRIEEGIKELGSQILKEHPVE

NTQLQNEKLYLYYLQNGRDMYVDQELDINRLSDYDVDAIV

PQSFLKDDSIDNKVLTRSDKNRGKSDNVPSEEVVKKMKNY
```

-continued

WRQLLNAKLITQRKFDNLTKAERGGLSELDKAGFIKRQLV

ETRQITKHVAQILDSRMNTKYDENDKLIREVKVITLKSKL

VSDFRKDFQFYKVREINNYHHAHDAYLNAVVGTALIKKYP

KLESEFVYGDYKVYDVRKMIAKSEQEIGKATAKYFFYSNI

MNFFKTEITLANGEIRKRPLIETNGETGEIVWDKGRDFAT

VRKVLSMPQVNIVKKTEVQTGGFSKESILPKRNSDKLIAR

KKDWDPKKYGGFDSPTVAYSVLVVAKVEKGKSKKLKSVKE

LLGITIMERSSFEKNPIDFLEAKGYKEVKKDLIIKLPKYS

LFELENGRKRMLASAGELQKGNELALPSKYVNFLYLASHY

EKLKGSPEDNEQKQLFVEQHKHYLDEIIEQISEFSKRVIL

ADANLDKVLSAYNKHRDKPIREQAENIIHLFTLTNLGAPA

AFKYFDTTIDRKRYTSTKEVLDATLIHQSITGLYETRIDL

SQLGGD

In some embodiments, a gene modifying polypeptide comprises a dCas9 sequence comprising a D10A and/or H840A mutation, e.g., the following sequence:

(SEQ ID NO: 5007)

SMDKKYSIGLAIGTNSVGWAVITDDYKVPSKKFKVLGNTDRHSIKKNLIG

ALLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEEN

PINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDA

ILLSDILRVNTEITKAPLSASMIKRYDEHHQDLTLLKALVRQQLPEKYKE

IFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFD

KNLPNEKVLPKHSLLYEYFTVYNELTKVKYVTEGMRKPAFLSGEQKKAIV

DLLFKTNRKVTVKQLKEDYFKKIECFDSVEISGVEDRFNASLGTYHDLLK

IIKDKDFLDNEENEDILEDIVLTLTLFEDREMIEERLKTYAHLFDDKVMK

QLKRRRYTGWGRLSRKLINGIRDKQSGKTILDFLKSDGFANRNFMQLIHD

DSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEH

PVENTQLQNEKLYLYYLQNGRDMYVDQELDINRLSDYDVDAIVPQSFLKD

DSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKL

IREVKVITLKSKLVSDFRKDFQFYKVREINNYHHAHDAYLNAVVGTALIK

-continued

KYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKV

EKGKSKKLKSVKELLGITIMERSSFEKNPIDFLEAKGYKEVKKDLIIKLP

KYSLFELENGRKRMLASAGELQKGNELALPSKYVNFLYLASHYEKLKGSP

EDNEQKQLFVEQHKHYLDEIIEQISEFSKRVILADANLDKVLSAYNKHRD

KPIREQAENIIHLFTLTNLGAPAAFKYFDTTIDRKRYTSTKEVLDATLIH

QSITGLYETRIDLSQLGGD

TAL Effectors and Zinc Finger Nucleases

In some embodiments, an endonuclease domain or DNA-binding domain comprises a TAL effector molecule. A TAL effector molecule, e.g., a TAL effector molecule that specifically binds a DNA sequence, typically comprises a plurality of TAL effector domains or fragments thereof, and optionally one or more additional portions of naturally occurring TAL effectors (e.g., N- and/or C-terminal of the plurality of TAL effector domains). Many TAL effectors are known to those of skill in the art and are commercially available, e.g., from Thermo Fisher Scientific.

Naturally occurring TALEs are natural effector proteins secreted by numerous species of bacterial pathogens including the plant pathogen *Xanthomonas* which modulates gene expression in host plants and facilitates bacterial colonization and survival. The specific binding of TAL effectors is based on a central repeat domain of tandemly arranged nearly identical repeats of typically 33 or 34 amino acids (the repeat-variable di-residues, RVD domain).

Members of the TAL effectors family differ mainly in the number and order of their repeats. The number of repeats typically ranges from 1.5 to 33.5 repeats and the C-terminal repeat is usually shorter in length (e.g., about 20 amino acids) and is generally referred to as a "half-repeat." Each repeat of the TAL effector generally features a one-repeat-to-one-base-pair correlation with different repeat types exhibiting different base-pair specificity (one repeat recognizes one base-pair on the target gene sequence). Generally, the smaller the number of repeats, the weaker the protein-DNA interactions. A number of 6.5 repeats has been shown to be sufficient to activate transcription of a reporter gene (Scholze et al., 2010).

Repeat to repeat variations occur predominantly at amino acid positions 12 and 13, which have therefore been termed "hypervariable" and which are responsible for the specificity of the interaction with the target DNA promoter sequence, as shown in Table 9 listing exemplary repeat variable diresidues (RVD) and their correspondence to nucleic acid base targets.

TABLE 9

| RVDs and Nucleic Acid Base Specificity | | | | | | | | | | | | | |
|---|---|---|---|---|---|---|---|---|---|---|---|---|---|
| Target | Possible RVD Amino Acid Combinations | | | | | | | | | | | | |
| A | NI | NN | NI | HI | KI | | | | | | | | |
| G | NN | GN | SN | VN | LN | DN | QN | EN | HN | RH | NK | AN | FN |
| C | HD | RD | KD | ND | AD | | | | | | | | |
| T | NG | HG | VG | IG | EG | MG | YG | AA | EP | VA | QG | KG | RG |

Accordingly, it is possible to modify the repeats of a TAL effector to target specific DNA sequences. Further studies have shown that the RVD NK can target G. Target sites of TAL effectors also tend to include a T flanking the 5' base targeted by the first repeat, but the exact mechanism of this recognition is not known. More than 113 TAL effector sequences are known to date. Non-limiting examples of TAL effectors from *Xanthomonas* include, Hax2, Hax3, Hax4, AvrXa7, AvrXa10 and AvrBs3.

Accordingly, the TAL effector domain of a TAL effector molecule described herein may be derived from a TAL effector from any bacterial species (e.g., *Xanthomonas* species such as the African strain of *Xanthomonas oryzae* pv. *Oryzae* (Yu et al. 2011), *Xanthomonas campestris* pv. *raphani* strain 756C and *Xanthomonas oryzae* pv. *oryzicola* strain BLS256 (Bogdanove et al. 2011). In some embodiments, the TAL effector domain comprises an RVD domain as well as flanking sequence(s) (sequences on the N-terminal and/or C-terminal side of the RVD domain) also from the naturally occurring TAL effector. It may comprise more or fewer repeats than the RVD of the naturally occurring TAL effector. The TAL effector molecule can be designed to target a given DNA sequence based on the above code and others known in the art. The number of TAL effector domains (e.g., repeats (monomers or modules)) and their specific sequence can be selected based on the desired DNA target sequence. For example, TAL effector domains, e.g., repeats, may be removed or added in order to suit a specific target sequence. In an embodiment, the TAL effector molecule of the present invention comprises between 6.5 and 33.5 TAL effector domains, e.g., repeats. In an embodiment, TAL effector molecule of the present invention comprises between 8 and 33.5 TAL effector domains, e.g., repeats, e.g., between 10 and 25 TAL effector domains, e.g., repeats, e.g., between 10 and 14 TAL effector domains, e.g., repeats.

In some embodiments, the TAL effector molecule comprises TAL effector domains that correspond to a perfect match to the DNA target sequence. In some embodiments, a mismatch between a repeat and a target base-pair on the DNA target sequence is permitted as along as it allows for the function of the polypeptide comprising the TAL effector molecule. In general, TALE binding is inversely correlated with the number of mismatches. In some embodiments, the TAL effector molecule of a polypeptide of the present invention comprises no more than 7 mismatches, 6 mismatches, 5 mismatches, 4 mismatches, 3 mismatches, 2 mismatches, or 1 mismatch, and optionally no mismatch, with the target DNA sequence. Without wishing to be bound by theory, in general the smaller the number of TAL effector domains in the TAL effector molecule, the smaller the number of mismatches will be tolerated and still allow for the function of the polypeptide comprising the TAL effector molecule. The binding affinity is thought to depend on the sum of matching repeat-DNA combinations. For example, TAL effector molecules having 25 TAL effector domains or more may be able to tolerate up to 7 mismatches.

In addition to the TAL effector domains, the TAL effector molecule of the present invention may comprise additional sequences derived from a naturally occurring TAL effector. The length of the C-terminal and/or N-terminal sequence(s) included on each side of the TAL effector domain portion of the TAL effector molecule can vary and be selected by one skilled in the art, for example based on the studies of Zhang et al. (2011). Zhang et al., have characterized a number of C-terminal and N-terminal truncation mutants in Hax3 derived TAL-effector based proteins and have identified key elements, which contribute to optimal binding to the target sequence and thus activation of transcription. Generally, it was found that transcriptional activity is inversely correlated with the length of N-terminus. Regarding the C-terminus, an important element for DNA binding residues within the first 68 amino acids of the Hax 3 sequence was identified. Accordingly, in some embodiments, the first 68 amino acids on the C-terminal side of the TAL effector domains of the naturally occurring TAL effector is included in the TAL effector molecule. Accordingly, in an embodiment, a TAL effector molecule comprises 1) one or more TAL effector domains derived from a naturally occurring TAL effector; 2) at least 70, 80, 90, 100, 110, 120, 130, 140, 150, 170, 180, 190, 200, 220, 230, 240, 250, 260, 270, 280 or more amino acids from the naturally occurring TAL effector on the N-terminal side of the TAL effector domains; and/or 3) at least 68, 80, 90, 100, 110, 120, 130, 140, 150, 170, 180, 190, 200, 220, 230, 240, 250, 260 or more amino acids from the naturally occurring TAL effector on the C-terminal side of the TAL effector domains.

In some embodiments, an endonuclease domain or DNA-binding domain is or comprises a Zn finger molecule. A Zn finger molecule comprises a Zn finger protein, e.g., a naturally occurring Zn finger protein or engineered Zn finger protein, or fragment thereof. Many Zn finger proteins are known to those of skill in the art and are commercially available, e.g., from Sigma-Aldrich.

In some embodiments, a Zn finger molecule comprises a non-naturally occurring Zn finger protein that is engineered to bind to a target DNA sequence of choice. See, for example, Beerli, et al. (2002) Nature Biotechnol. 20:135-141; Pabo, et al. (2001) Ann. Rev. Biochem. 70:313-340; Isalan, et al. (2001) Nature Biotechnol. 19:656-660; Segal, et al. (2001) Curr. Opin. Biotechnol. 12:632-637; Choo, et al. (2000) Curr. Opin. Struct. Biol. 10:411-416; U.S. Pat. Nos. 6,453,242; 6,534,261; 6,599,692; 6,503,717; 6,689,558; 7,030,215; 6,794,136; 7,067,317; 7,262,054; 7,070,934; 7,361,635; 7,253,273; and U.S. Patent Publication Nos. 2005/0064474; 2007/0218528; 2005/0267061, all incorporated herein by reference in their entireties.

An engineered Zn finger protein may have a novel binding specificity, compared to a naturally-occurring Zn finger protein. Engineering methods include, but are not limited to, rational design and various types of selection. Rational design includes, for example, using databases comprising triplet (or quadruplet) nucleotide sequences and individual Zn finger amino acid sequences, in which each triplet or quadruplet nucleotide sequence is associated with one or more amino acid sequences of zinc fingers which bind the particular triplet or quadruplet sequence. See, for example, U.S. Pat. Nos. 6,453,242 and 6,534,261, incorporated by reference herein in their entireties.

Exemplary selection methods, including phage display and two-hybrid systems, are disclosed in U.S. Pat. Nos. 5,789,538; 5,925,523; 6,007,988; 6,013,453; 6,410,248; 6,140,466; 6,200,759; and 6,242,568; as well as International Patent Publication Nos. WO 98/37186; WO 98/53057; WO 00/27878; and WO 01/88197 and GB 2,338,237. In addition, enhancement of binding specificity for zinc finger proteins has been described, for example, in International Patent Publication No. WO 02/077227.

In addition, as disclosed in these and other references, zinc finger domains and/or multi-fingered zinc finger proteins may be linked together using any suitable linker sequences, including for example, linkers of 5 or more amino acids in length. See, also, U.S. Pat. Nos. 6,479,626; 6,903,185; and 7,153,949 for exemplary linker sequences 6 or more amino acids in length. The proteins described herein may include any combination of suitable linkers between the individual zinc fingers of the protein. In addition, enhancement of binding specificity for zinc finger binding domains has been described, for example, in co-owned International Patent Publication No. WO 02/077227.

Zn finger proteins and methods for design and construction of fusion proteins (and polynucleotides encoding same) are known to those of skill in the art and described in detail in U.S. Pat. Nos. 6,140,0815; 789,538; 6,453,242; 6,534,261; 5,925,523; 6,007,988; 6,013,453; and 6,200,759; International Patent Publication Nos. WO 95/19431; WO 96/06166; WO 98/53057; WO 98/54311; WO 00/27878; WO 01/60970; WO 01/88197; WO 02/099084; WO 98/53058; WO 98/53059; WO 98/53060; WO 02/016536; and WO 03/016496.

In addition, as disclosed in these and other references, Zn finger proteins and/or multi-fingered Zn finger proteins may be linked together, e.g., as a fusion protein, using any suitable linker sequences, including for example, linkers of 5 or more amino acids in length. See, also, U.S. Pat. Nos. 6,479,626; 6,903,185; and 7,153,949 for exemplary linker sequences 6 or more amino acids in length. The Zn finger molecules described herein may include any combination of suitable linkers between the individual zinc finger proteins and/or multi-fingered Zn finger proteins of the Zn finger molecule.

In certain embodiments, the DNA-binding domain or endonuclease domain comprises a Zn finger molecule comprising an engineered zinc finger protein that binds (in a sequence-specific manner) to a target DNA sequence. In some embodiments, the Zn finger molecule comprises one Zn finger protein or fragment thereof. In other embodiments, the Zn finger molecule comprises a plurality of Zn finger proteins (or fragments thereof), e.g., 2, 3, 4, 5, 6 or more Zn finger proteins (and optionally no more than 12, 11, 10, 9, 8, 7, 6, 5, 4, 3, or 2 Zn finger proteins). In some embodiments, the Zn finger molecule comprises at least three Zn finger proteins. In some embodiments, the Zn finger molecule comprises four, five or six fingers. In some embodiments, the Zn finger molecule comprises 8, 9, 10, 11 or 12 fingers. In some embodiments, a Zn finger molecule comprising three Zn finger proteins recognizes a target DNA sequence comprising 9 or 10 nucleotides. In some embodiments, a Zn finger molecule comprising four Zn finger proteins recognizes a target DNA sequence comprising 12 to 14 nucleotides. In some embodiments, a Zn finger molecule comprising six Zn finger proteins recognizes a target DNA sequence comprising 18 to 21 nucleotides.

In some embodiments, a Zn finger molecule comprises a two-handed Zn finger protein. Two handed zinc finger proteins are those proteins in which two clusters of zinc finger proteins are separated by intervening amino acids so that the two zinc finger domains bind to two discontinuous target DNA sequences. An example of a two handed type of zinc finger binding protein is SIP1, where a cluster of four zinc finger proteins is located at the amino terminus of the protein and a cluster of three Zn finger proteins is located at the carboxyl terminus (see Remade, et al. (1999) EMBO Journal 18(18):5073-5084). Each cluster of zinc fingers in these proteins is able to bind to a unique target sequence and the spacing between the two target sequences can comprise many nucleotides.

Linkers

In some embodiments, a gene modifying polypeptide may comprise a linker, e.g., a peptide linker, e.g., a linker as described in Table 10. In some embodiments, a gene modifying polypeptide comprises, in an N-terminal to C-terminal direction, a Cas domain (e.g., a Cas domain of Table 8), a linker of Table 10 (or a sequence having at least 70%, 80%, 85%, 90%, 95%, or 99% identity thereto), and an RT domain (e.g., an RT domain of Table 6). In some embodiments, a gene modifying polypeptide comprises a flexible linker between the endonuclease and the RT domain, e.g., a linker comprising the amino acid sequence SGGSSGGSSGSETPGTSESATPESSGGSSGGSS (SEQ ID NO: 11,002). In some embodiments, an RT domain of a gene modifying polypeptide may be located C-terminal to the endonuclease domain. In some embodiments, an RT domain of a gene modifying polypeptide may be located N-terminal to the endonuclease domain.

TABLE 10

Exemplary linker sequences

| Amino Acid Sequence | SEQ ID NO |
|---|---|
| GGS | |
| GGSGGS | 5102 |
| GGSGGSGGS | 5103 |
| GGSGGSGGSGGS | 5104 |
| GGSGGSGGSGGSGGS | 5105 |
| GGSGGSGGSGGSGGSGGS | 5106 |
| GGGGS | 5107 |
| GGGGSGGGGS | 5108 |
| GGGGSGGGGSGGGGS | 5109 |
| GGGGGGGGSGGGGSGGGGS | 5110 |
| GGGGGGGGSGGGGSGGGGSGGGGS | 5111 |
| GGGGSGGGGSGGGGSGGGGSGGGGSGGGGS | 5112 |
| GGG | |
| GGGG | 5114 |
| GGGGG | 5115 |

TABLE 10-continued

Exemplary linker sequences

| Amino Acid Sequence | SEQ ID NO |
|---|---|
| GGGGGG | 5116 |
| GGGGGGG | 5117 |
| GGGGGGGG | 5118 |
| GSS | |
| GSSGSS | 5120 |
| GSSGSSGSS | 5121 |
| GSSGSSGSSGSS | 5122 |
| GSSGSSGSSGSSGSS | 5123 |
| GSSGSSGSSGSSGSSGSS | 5124 |
| EAAAK | 5125 |
| EAAAKEAAAK | 5126 |
| EAAAKEAAAKEAAAK | 5127 |
| EAAAKEAAAKEAAAKEAAAK | 5128 |
| EAAAKEAAAKEAAAKEAAAKEAAAK | 5129 |
| EAAAKEAAAKEAAAKEAAAKEAAAKEAAAK | 5130 |
| PAP | |
| PAPAP | 5132 |
| PAPAPAP | 5133 |
| PAPAPAPAP | 5134 |
| PAPAPAPAPAP | 5135 |
| PAPAPAPAPAPAP | 5136 |
| GGSGGG | 5137 |
| GGGGGS | 5138 |
| GGSGSS | 5139 |
| GSSGGS | 5140 |
| GGSEAAAK | 5141 |
| EAAAKGGS | 5142 |
| GGSPAP | 5143 |
| PAPGGS | 5144 |
| GGGGSS | 5145 |
| GSSGGG | 5146 |
| GGGEAAAK | 5147 |
| EAAAKGGG | 5148 |
| GGGPAP | 5149 |
| PAPGGG | 5150 |
| GSSEAAAK | 5151 |
| EAAAKGSS | 5152 |
| GSSPAP | 5153 |

TABLE 10-continued

Exemplary linker sequences

| Amino Acid Sequence | SEQ ID NO |
|---|---|
| PAPGSS | 5154 |
| EAAAKPAP | 5155 |
| PAPEAAAK | 5156 |
| GGSGGGGSS | 5157 |
| GGSGSSGGG | 5158 |
| GGGGGSGSS | 5159 |
| GGGGSSGGS | 5160 |
| GSSGGSGGG | 5161 |
| GSSGGGGGS | 5162 |
| GGSGGGEAAAK | 5163 |
| GGSEAAAKGGG | 5164 |
| GGGGGSEAAAK | 5165 |
| GGGEAAAKGGS | 5166 |
| EAAAKGGSGGG | 5167 |
| EAAAKGGGGGS | 5168 |
| GGSGGGPAP | 5169 |
| GGSPAPGGG | 5170 |
| GGGGGSPAP | 5171 |
| GGGPAPGGS | 5172 |
| PAPGGSGGG | 5173 |
| PAPGGGGGS | 5174 |
| GGSGSSEAAAK | 5175 |
| GGSEAAAKGSS | 5176 |
| GSSGGSEAAAK | 5177 |
| GSSEAAAKGGS | 5178 |
| EAAAKGGSGSS | 5179 |
| EAAAKGSSGGS | 5180 |
| GGSGSSPAP | 5181 |
| GGSPAPGSS | 5182 |
| GSSGGSPAP | 5183 |
| GSSPAPGGS | 5184 |
| PAPGGSGSS | 5185 |
| PAPGSSGGS | 5186 |
| GGSEAAAKPAP | 5187 |
| GGSPAPEAAAK | 5188 |
| EAAAKGGSPAP | 5189 |
| EAAAKPAPGGS | 5190 |

TABLE 10-continued

Exemplary linker sequences

| Amino Acid Sequence | SEQ ID NO |
|---|---|
| PAPGGSEAAAK | 5191 |
| PAPEAAAKGGS | 5192 |
| GGGGSSEAAAK | 5193 |
| GGGEAAAKGSS | 5194 |
| GSSGGGEAAAK | 5195 |
| GSSEAAAKGGG | 5196 |
| EAAAKGGGGSS | 5197 |
| EAAAKGSSGGG | 5198 |
| GGGGSSPAP | 5199 |
| GGGPAPGSS | 5200 |
| GSSGGGPAP | 5201 |
| GSSPAPGGG | 5202 |
| PAPGGGGSS | 5203 |
| PAPGSSGGG | 5204 |
| GGGEAAAKPAP | 5205 |
| GGGPAPEAAAK | 5206 |
| EAAAKGGGPAP | 5207 |
| EAAAKPAPGGG | 5208 |
| PAPGGGEAAAK | 5209 |
| PAPEAAAKGGG | 5210 |
| GSSEAAAKPAP | 5211 |
| GSSPAPEAAAK | 5212 |
| EAAAKGSSPAP | 5213 |
| EAAAKPAPGSS | 5214 |
| PAPGSSEAAAK | 5215 |
| PAPEAAAKGSS | 5216 |
| AEAAAKEAAAKEAAAKEAAAKALEAEAAAKEAA AKEAAAKEAAAKA | 5217 |
| GGGGSEAAAKGGGGS | 5218 |
| EAAAKGGGGSEAAAK | 5219 |
| SGSETPGTSESATPES | 5220 |
| GSAGSAAGSGEF | 5221 |
| SGGSSGGSSGSETPGTSESATPESSGGSSGGSS | 5222 |

In some embodiments, a linker of a gene modifying polypeptide comprises a motif chosen from: $(SGGS)_n$ (SEQ ID NO: 5025), $(GGGS)_n$ (SEQ ID NO: 5026), $(GGGGS)_n$ (SEQ ID NO: 5027), $(G)_n$, $(EAAAK)_n$ (SEQ ID NO: 5028), $(GGS)_n$, or $(XP)_n$.

Gene Modifying Polypeptide Selection by Pooled Screening

Candidate gene modifying polypeptides may be screened to evaluate a candidate's gene editing ability. For example, an RNA gene modifying system designed for the targeted editing of a coding sequence in the human genome may be used. In certain embodiments, such a gene modifying system may be used in conjunction with a pooled screening approach.

For example, a library of gene modifying polypeptide candidates and a template guide RNA (tgRNA) may be introduced into mammalian cells to test the candidates' gene editing abilities by a pooled screening approach. In specific embodiments, a library of gene modifying polypeptide candidates is introduced into mammalian cells followed by introduction of the tgRNA into the cells.

Representative, non-limiting examples of mammalian cells that may be used in screening include HEK293T cells, U2OS cells, HeLa cells, HepG2 cells, Huh7 cells, K562 cells, or iPS cells.

A gene modifying polypeptide candidate may comprise 1) a Cas-nuclease, for example a wild-type Cas nuclease, e.g., a wild-type Cas9 nuclease, a mutant Cas nuclease, e.g., a Cas nickase, for example, a Cas9 nickase such as a Cas9 N863A nickase, or a Cas nuclease selected from Table 7 or Table 8, 2) a peptide linker, e.g., a sequence from Table D or Table 10, that may exhibit varying degrees of length, flexibility, hydrophobicity, and/or secondary structure; and 3) a reverse transcriptase (RT), e.g. an RT domain from Table D or Table 6. A gene modifying polypeptide candidate library comprises: a plurality of different gene modifying polypeptide candidates that differ from each other with respect to one, two or all three of the Cas nuclease, peptide linker or RT domain components, or a plurality of nucleic acid expression vectors that encode such gene modifying polypeptide candidates.

For screening of gene modifying polypeptide candidates, a two-component system may be used that comprises a gene modifying polypeptide component and a tgRNA component. A gene modifying component may comprise, for example, an expression vector, e.g., an expression plasmid or lentiviral vector, that encodes a gene modifying polypeptide candidate, for example, comprises a human codon-optimized nucleic acid that encodes a gene modifying polypeptide candidate, e.g., a Cas-linker-RT fusion as described above. In a particular embodiment, a lentiviral cassette is utilized that comprises: (i) a promoter for expression in mammalian cells, e.g., a CMV promoter; (ii) a gene modifying library candidate, e.g. a Cas-linker-RT fusion comprising a Cas nuclease of Table 7 or Table 8, a peptide linker of Table 10, and an RT of Table 6, for example a Cas-linker-RT fusion as in Table D; (iii) a self-cleaving polypeptide, e.g., a T2A peptide; (iv) a marker enabling selection in mammalian cells, e.g., a puromycin resistance gene; and (v) a termination signal, e.g., a poly A tail.

The tgRNA component may comprise a tgRNA or expression vector, e.g., an expression plasmid, that produces the tgRNA, for example, utilizes a U6 promoter to drive expression of the tgRNA, wherein the tgRNA is a non-coding RNA sequence that is recognized by Cas and localizes it to the genomic locus of interest, and that also templates reverse transcription of the desired edit into the genome by the RT domain.

To prepare a pool of cells expressing gene modifying polypeptide library candidates, mammalian cells, e.g., HEK293T or U2OS cells, may be transduced with pooled gene modifying polypeptide candidate expression vector preparations, e.g., lentiviral preparations, of the gene modifying candidate polypeptide library. In a particular embodiment, lentiviral plasmids are utilized, and HEK293 Lenti-X cells are seeded in 15 cm plates (~$12\times10^6$ cells) prior to lentiviral plasmid transfection. In such an embodiment, lentiviral plasmid transfection may be performed using the Lentiviral Packaging Mix (Biosettia) and transfection of the plasmid DNA for the gene modifying candidate library is performed the following day using Lipofectamine 2000 and Opti-MEM media according to the manufacturer's protocol. In such an embodiment, extracellular DNA may be removed by a full media change the next day and virus-containing media may be harvested 48 hours after. Lentiviral media may be concentrated using Lenti-X Concentrator (TaKaRa Biosciences) and 5 mL lentiviral aliquots may be made and stored at −80° C. Lentiviral titering is performed by enumerating colony forming units post-selection, e.g., post Puromycin selection.

For monitoring gene editing of a target DNA, mammalian cells, e.g., HEK293T or U2OS cells, carrying a target DNA may be utilized. In other embodiments for monitoring gene editing of a target DNA, mammalian cells, e.g., HEK293T or U2OS cells, carrying a target DNA genomic landing pad may be utilized. In particular embodiments, the target DNA genomic landing pad may comprise a gene to be edited for treatment of a disease or disorder of interest. In other particular embodiments, the target DNA is a gene sequence that expresses a protein that exhibits detectable characteristics that may be monitored to determine whether gene editing has occurred. For example, in certain embodiments, a blue fluorescence protein (BFP)- or green fluorescence protein (GFP)-expressing genomic landing pad is utilized. In certain embodiments, mammalian cells, HEK293T or U2OS cells, comprising a target DNA, e.g., a target DNA genomic landing pad, are seeded in culture plates at 500×-3000× cells per gene modifying library candidate and transduced at a 0.2-0.3 multiplicity of infection (MOI) to minimize multiple infections per cell. Puromycin (2.5 ug/mL) may be added 48 hours post infection to allow for selection of infected cells. In such an embodiment, cells may be kept under puromycin selection for at least 7 days and then scaled up for tgRNA introduction, e.g., tgRNA electroporation.

To ascertain whether gene editing occurs, mammalian cells containing a target DNA to be edited may be infected with gene modifying polypeptide library candidates then transfected with tgRNA designed for use in editing of the target DNA. Subsequently, the cells may be analyzed to determine whether editing of the target locus has occurred according to the designed outcome, or whether no editing or imperfect editing has occurred, e.g., by using cell sorting and sequence analysis.

In a particular embodiment, to ascertain whether genome editing occurs, BFP- or GFP-expressing mammalian cells, e.g., HEK293T or U2OS cells, may be infected with gene modifying library candidates and then transfected or electroporated with tgRNA plasmid or RNA, e.g., by electroporation of 250,000 cells/well with 200 ng of a tgRNA plasmid designed to convert BFP-to-GFP or GFP-to-BFP, at a cell count ensuring >250×-1000× coverage per library candidate. In such an embodiment, the genome-editing capacity of the various constructs in this assay may be assessed by sorting the cells by Fluorescence-Activated Cell Sorting (FACS) for expression of the color-converted fluorescent protein (FP) at 4-10 days post-electroporation. Cells are sorted and harvested as distinct populations of unedited cells (exhibiting original florescence protein signal), edited cells (exhibiting converted fluorescence protein signal), and imperfect edit (exhibiting no florescence protein signal) cells. A sample of unsorted cells may also be harvested as the input population to determine candidate enrichment during analysis.

To determine which gene modifying library candidates exhibit genome-editing capacity in an assay, genomic DNA (gDNA) is harvested from the sorted cell populations, and analyzed by sequencing the gene modifying library candidates in each population. Briefly, gene modifying candidates may be amplified from the genome using primers specific to the gene modifying polypeptide expression vector, e.g., the lentiviral cassette, amplified in a second round of PCR to dilute genomic DNA, and then sequenced, for example, sequenced by a next-generation sequencing platform. After quality control of sequencing reads, reads of at least about 1500 nucleotides and generally no more than about 3200 nucleotides are mapped to the gene modifying polypeptide library sequences and those containing a minimum of about an 80% match to a library sequence are considered to be successfully aligned to a given candidate for purposes of this pooled screen. In order to identify candidates capable of performing gene editing in the assay, e.g., the BFP-to-GFP or GFP-to-BFP edit, the read count of each library candidate in the edited population is compared to its read count in the initial, unsorted population.

For purposes of pooled screening, gene modifying candidates with genome-editing capacity are identified based on enrichment in the edited (converted FP) population relative to unsorted (input) cells. In some embodiments, an enrichment of at least 1.0, 1.5, 2.0, 2.5, 3.0, 4.0, 5.0, 6.0, 7.0, 8.0, 9.0, 10, 15, 20, 25, 30, 40, 50, 60, 70, 80, 90, or at least 100-fold over the input indicates potentially useful gene editing activity, e.g., at least 2-fold enrichment. In some embodiments, the enrichment is converted to a log-value by taking the log base 2 of the enrichment ratio. In some embodiments, a log 2 enrichment score of at least 0, 1, 2, 3, 4, 5, 5.5, 6.0, 6.2, 6.3, 6.4, 6.5, or at least 6.6 indicates potentially useful gene editing activity, e.g., a log 2 enrichment score of at least 1.0. In particular embodiments, enrichment values observed for gene modifying candidates may be compared to enrichment values observed under similar conditions utilizing a reference, e.g., Element ID No: 17380.

In some embodiments, multiple tgRNAs may be used to screen the gene modifying candidate library. In particular embodiments, a plurality of tgRNAs may be utilized to optimize template/Cas-linker-RT fusion pairs, e.g., for gene editing of particular target genes, for example, gene targets for the treatment of disease. In specific embodiments, a pooled approach to screening gene modifying candidates may be performed using a multiplicity of different tgRNAs in an arrayed format.

In some embodiments, multiple types of edits, e.g., insertions, substitutions, and/or deletions of different lengths, may be used to screen the gene modifying candidate library.

In some embodiments, multiple target sequences, e.g., different fluorescent proteins, may be used to screen the gene modifying candidate library. In some embodiments, multiple target sequences, e.g., different fluorescent proteins, may be used to screen the gene modifying candidate library. In some embodiments, multiple cell types, e.g., HEK293T or U20S, may be used to screen the gene modifying candidate library. The person of ordinary skill in the art will appreciate that a given candidate may exhibit altered editing capacity or even the gain or loss of any observable or useful activity across different conditions, including tgRNA sequence (e.g., nucleotide modifications, PBS length, RT template length), target sequence, target location, type of edit, location of mutation relative to the first-strand nick of the gene modifying polypeptide, or cell type. Thus, in some embodiments, gene modifying library candidates are screened across multiple parameters, e.g., with at least two distinct tgRNAs in at least two cell types, and gene editing activity is identified by enrichment in any single condition. In other embodiments, a candidate with more robust activity across different tgRNA and cell types is identified by enrichment in at least two conditions, e.g., in all conditions screened. For clarity, candidates found to exhibit little to no enrichment under any given condition are not assumed to be inactive across all conditions and may be screened with different parameters or reconfigured at the polypeptide level, e.g., by swapping, shuffling, or evolving domains (e.g., RT domain), linkers, or other signals (e.g., NLS).

Sequences of Exemplary Cas9-Linker-RT Fusions

In some embodiments, a gene modifying polypeptide comprises a linker sequence and an RT sequence. In some embodiments, a gene modifying polypeptide comprises a linker sequence as listed in Table D, or an amino acid sequence having at least 75%, 80%, 85%, 90%, 95%, 96%, 97%, 98%, or 99% identity thereto. In some embodiments, a gene modifying polypeptide comprises the amino acid sequence of an RT domain as listed in Table D, or an amino acid sequence having at least 75%, 80%, 85%, 90%, 95%, 96%, 97%, 98%, or 99% identity thereto. In some embodiments, a gene modifying polypeptide comprises a linker sequence as listed in Table D, or an amino acid sequence having at least 75%, 80%, 85%, 90%, 95%, 96%, 97%, 98%, or 99% identity thereto; and the amino acid sequence of an RT domain as listed in Table D, or an amino acid sequence having at least 75%, 80%, 85%, 90%, 95%, 96%, 97%, 98%, or 99% identity thereto. In some embodiments, a gene modifying polypeptide comprises: (i) a linker sequence as listed in a row of Table D, or an amino acid sequence having at least 75%, 80%, 85%, 90%, 95%, 96%, 97%, 98%, or 99% identity thereto; and (ii) the amino acid sequence of an RT domain as listed in the same row of Table D, or an amino acid sequence having at least 75%, 80%, 85%, 90%, 95%, 96%, 97%, 98%, or 99% identity thereto.

Exemplary Gene Modifying Polypeptides

In some embodiments, a gene modifying polypeptide (e.g., a gene modifying polypeptide that is part of a system described herein) comprises an amino acid sequence of any one of SEQ ID NOs: 1-7743, or an amino acid sequence having at least 70%, 75%, 80%, 85%, 90%, 95%, or 99% identity thereto. In some embodiments, a gene modifying polypeptide comprises an amino acid sequence of any one of SEQ ID NOs: 1-7743, or an amino acid sequence having at least 80% identity thereto. In some embodiments, a gene modifying polypeptide comprises an amino acid sequence of any one of SEQ ID NOs: 1-7743, or an amino acid sequence having at least 90% identity thereto. In some embodiments, a gene modifying polypeptide comprises an amino acid sequence of any one of SEQ ID NOs: 1-7743, or an amino acid sequence having at least 95% identity thereto. In some embodiments, a gene modifying polypeptide comprises an amino acid sequence of any one of SEQ ID NOs: 1-7743, or an amino acid sequence having at least 99% identity thereto. In some embodiments, a gene modifying polypeptide comprises an amino acid sequence of any one of SEQ ID NOs: 1-7743. In some embodiments, a gene modifying polypeptide comprises an amino acid sequence of any one of SEQ ID NOs: 6001-7743, or an amino acid sequence having at least 70%, 75%, 80%, 85%, 90%, 95%, or 99% identity thereto. In some embodiments, a gene modifying polypeptide comprises an amino acid sequence of any one of SEQ ID NOs: 4501-4541, or an amino acid sequence having at least 70%, 75%, 80%, 85%, 90%, 95%, or 99% identity thereto.

In some embodiments, a gene modifying polypeptide comprises an amino acid sequence as listed in Table A1, or an amino acid sequence having at least 70%, 75%, 80%, 85%, 90%, 95%, or 99% identity thereto.

In some embodiments, a gene modifying polypeptide comprises an amino acid sequence as listed in Table T1, or an amino acid sequence having at least 70%, 75%, 80%, 85%, 90%, 95%, or 99% identity thereto. In some embodiments, a gene modifying polypeptide comprises a linker comprising a linker sequence as listed in Table T1, or an amino acid sequence having at least 70%, 75%, 80%, 85%, 90%, 95%, or 99% identity thereto. In some embodiments, a gene modifying polypeptide comprises an RT domain comprising an RT domain sequence as listed in Table T1, or an amino acid sequence having at least 70%, 75%, 80%, 85%, 90%, 95%, or 99% identity thereto. In some embodiments, a gene modifying polypeptide comprises: (i) a linker comprising a linker sequence as listed in a row of Table T1, or an amino acid sequence having at least 70%, 75%, 80%, 85%, 90%, 95%, or 99% identity thereto; and (ii) an RT domain comprising an RT domain sequence as listed in the same row of Table T1, or an amino acid sequence having at least 70%, 75%, 80%, 85%, 90%, 95%, or 99% identity thereto.

TABLE T1

Selection of exemplary gene modifying polypeptides

| SEQ ID NO: for Full Polypeptide Sequence | Linker Sequence | SEQ ID NO: of linker | RT name |
|---|---|---|---|
| 1372 | AEAAAKEAAAKEAAAKEAAAKALEAEAAAKEAAAKEAAAKEAAAKA | 15,401 | AVIRE_P03360_3mutA |
| 1197 | AEAAAKEAAAKEAAAKEAAAKALEAEAAAKEAAAKEAAAKEAAAKA | 15,402 | FLV_P10273_3mutA |
| 2784 | AEAAAKEAAAKEAAAKEAAAKALEAEAAAKEAAAKEAAAKEAAAKA | 15,403 | MLVMS_P03355_3mutA_WS |
| 647 | AEAAAKEAAAKEAAAKEAAAKALEAEAAAKEAAAKEAAAKEAAAKA | 15,404 | SFV3L_P27401_2mutA |

In some embodiments, a gene modifying polypeptide comprises an amino acid sequence as listed in Table T2, or an amino acid sequence having at least 70%, 75%, 80%, 85%, 90%, 95%, or 99% identity thereto. In some embodiments, a gene modifying polypeptide comprises a linker comprising a linker sequence as listed in Table T2, or an amino acid sequence having at least 70%, 75%, 80%, 85%, 90%, 95%, or 99% identity thereto. In some embodiments, a gene modifying polypeptide comprises an RT domain comprising an RT domain sequence as listed in Table T2, or an amino acid sequence having at least 70%, 75%, 80%, 85%, 90%, 95%, or 99% identity thereto. In some embodiments, a gene modifying polypeptide comprises: (i) a linker comprising a linker sequence as listed in a row of Table T2, or an amino acid sequence having at least 70%, 75%, 80%, 85%, 90%, 95%, or 99% identity thereto; and (ii) an RT domain comprising an RT domain sequence as listed in the same row of Table T2, or an amino acid sequence having at least 70%, 75%, 80%, 85%, 90%, 95%, or 99% identity thereto.

TABLE T2

| Selection of exemplary gene modifying polypeptides | | | |
|---|---|---|---|
| SEQ ID NO: for Full Polypeptide Sequence | Linker Sequence | SEQ ID NO: of linker | RT name |
| 2311 | GGGGSGGGGSGGGGSGGGGS | 15,405 | MLVCB_P08361_3mutA |
| 1373 | GGGGGGGGSGGGGSGGGGSGGGGSGGGGS | 15,406 | AVIRE_P03360_3mutA |
| 2644 | GGGGSGGGGSGGGGSGGGGSGGGGSGGGGS | 15,407 | MLVMS_P03355_PLV919 |
| 2304 | GSSGSSGSSGSSGSSGSS | 15,408 | MLVCB_P08361_3mutA |
| 2325 | EAAAKEAAAKEAAAKEAAAK | 15,409 | MLVCB_P08361_3mutA |
| 2322 | EAAAKEAAAKEAAAKEAAAKEAAAKEAAAK | 15,410 | MLVCB_P08361_3mutA |
| 2187 | PAPAPAPAPAP | 15,411 | MLVBM_Q7SVK7_3mut |
| 2309 | PAPAPAPAPAPAP | 15,412 | MLVCB_P08361_3mutA |
| 2534 | PAPAPAPAPAPAP | 15,413 | MLVFF_P26809_3mutA |
| 2797 | PAPAPAPAPAPAP | 15,414 | MLVMS_P03355_3mutA_WS |
| 3084 | PAPAPAPAPAPAP | 15,415 | MLVMS_P03355_3mutA_WS |
| 2868 | PAPAPAPAPAPAP | 15,416 | MLVMS_P03355_PLV919 |
| 126 | EAAAKGGG | 15,417 | PERV_Q4VFZ2_3mut |
| 306 | EAAAKGGG | 15,418 | PERV_Q4VFZ2_3mut |
| 1410 | PAPGGG | 15,419 | AVIRE_P03360_3mutA |
| 804 | GGGGSSGGS | 15,420 | WMSV_P03359_3mut |
| 1937 | GGGGGSEAAAK | 15,421 | BAEVM_P10272_3mutA |
| 2721 | GGGEAAAKGGS | 15,422 | MLVMS_P03355_3mut |
| 3018 | GGGEAAAKGGS | 15,423 | MLVMS_P03355_3mut |
| 1018 | GGGEAAAKGGS | 15,424 | XMRV6_A1Z651_3mutA |
| 2317 | GGSGGGPAP | 15,425 | MLVCB_P08361_3mutA |
| 2649 | PAPGGSGGG | 15,426 | MLVMS_P03355_PLV919 |
| 2878 | PAPGGSGGG | 15,427 | MLVMS_P03355_PLV919 |
| 912 | GGSEAAAKPAP | 15,428 | WMSV_P03359_3mutA |
| 2338 | GGSPAPEAAAK | 15,429 | MLVCB_P08361_3mutA |
| 2527 | GGSPAPEAAAK | 15,430 | MLVFF_P26809_3mutA |
| 141 | EAAAKGGSPAP | 15,431 | PERV_Q4VFZ2_3mut |
| 341 | EAAAKGGSPAP | 15,432 | PERV_Q4VFZ2_3mut |
| 2315 | EAAAKPAPGGS | 15,433 | MLVCB_P08361_3mutA |
| 3080 | EAAAKPAPGGS | 15,434 | MLVMS_P03355_3mutA_WS |
| 2688 | GGGGSSEAAAK | 15,435 | MLVMS_P03355_PLV919 |
| 2885 | GGGGSSEAAAK | 15,436 | MLVMS_P03355_PLV919 |
| 2810 | GSSGGGEAAAK | 15,437 | MLVMS_P03355_3mutA_WS |
| 3057 | GSSGGGEAAAK | 15,438 | MLVMS_P03355_3mutA_WS |
| 1861 | GSSEAAAKGGG | 15,439 | MLVAV_P03356_3mutA |
| 3056 | GSSGGGPAP | 15,440 | MLVMS_P03355_3mutA_WS |
| 1038 | GSSPAPGGG | 15,441 | XMRV6_A1Z651_3mutA |

TABLE T2-continued

Selection of exemplary gene modifying polypeptides

| SEQ ID NO: for Full Polypeptide Sequence | Linker Sequence | SEQ ID NO: of linker | RT name |
|---|---|---|---|
| 2308 | PAPGGGGSS | 15,442 | MLVCB_P08361_3mutA |
| 1672 | GGGEAAAKPAP | 15,443 | KORV_Q9TTC1-Pro_3mutA |
| 2526 | GGGEAAAKPAP | 15,444 | MLVFF_P26809_3mutA |
| 1938 | GGGPAPEAAAK | 15,445 | BAEVM_P10272_3mutA |
| 2641 | GSSEAAAKPAP | 15,446 | MLVMS_P03355_PLV919 |
| 2891 | GSSEAAAKPAP | 15,447 | MLVMS_P03355_PLV919 |
| 1225 | GSSPAPEAAAK | 15,448 | FLV_P10273_3mutA |
| 2839 | GSSPAPEAAAK | 15,449 | MLVMS_P03355_3mutA_WS |
| 3127 | GSSPAPEAAAK | 15,450 | MLVMS_P03355_3mutA_WS |
| 2798 | PAPGSSEAAAK | 15,451 | MLVMS_P03355_3mutA_WS |
| 3091 | PAPGSSEAAAK | 15,452 | MLVMS_P03355_3mutA_WS |
| 1372 | AEAAAKEAAAKEAAAKEAAAKALEAEAAAKEAAAKEAAAKEAAAKA | 15,453 | AVIRE_P03360_3mutA |
| 1197 | AEAAAKEAAAKEAAAKEAAAKALEAEAAAKEAAAKEAAAKEAAAKA | 15,454 | FLV_P10273_3mutA |
| 2611 | AEAAAKEAAAKEAAAKEAAAKALEAEAAAKEAAAKEAAAKEAAAKA | 15,455 | MLVMS_P03355_PLV919 |
| 2784 | AEAAAKEAAAKEAAAKEAAAKALEAEAAAKEAAAKEAAAKEAAAKA | 15,456 | MLVMS_P03355_3mutA_WS |
| 480 | AEAAAKEAAAKEAAAKEAAAKALEAEAAAKEAAAKEAAAKEAAAKA | 15,457 | SFV1_P23074_2mutA |
| 647 | AEAAAKEAAAKEAAAKEAAAKALEAEAAAKEAAAKEAAAKEAAAKA | 15,458 | SFV3L_P27401_2mutA |
| 1006 | AEAAAKEAAAKEAAAKEAAAKALEAEAAAKEAAAKEAAAKEAAAKA | 15,459 | XMRV6_A1Z651_3mutA |
| 2518 | SGSETPGTSESATPES | 15,460 | MLVFF_P26809_3mutA |

Subsequences of Exemplary Gene Modifying Polypeptides

In some embodiments, the gene modifying polypeptide comprises, in N-terminal to C-terminal order, one or more (e.g., 1, 2, 3, 4, 5, or all 6) of an N-terminal methionine residue, a first nuclear localization signal (NLS), a DNA binding domain, a linker, an RT domain, and/or a second NLS. In some embodiments, a gene modifying polypeptide comprises, in N-terminal to C-terminal order, a NLS (e.g., a first NLS), a DNA binding domain, a linker, and an RT domain, wherein the linker and RT domain are the linker and RT domain of a gene modifying polypeptide of any one of SEQ ID NOs: 1-7743, or an amino acid sequence having at least 70%, 75%, 80%, 85%, 90%, 95%, or 99% identity to said linker and RT domain. In some embodiments, a gene modifying polypeptide comprises, in N-terminal to C-terminal order, a DNA binding domain, a linker, an RT domain, and an NLS (e.g., a second NLS) wherein the linker and RT domain are the linker and RT domain of a gene modifying polypeptide of any one of SEQ ID NOs: 1-7743, or an amino acid sequence having at least 70%, 75%, 80%, 85%, 90%, 95%, or 99% identity to said linker and RT domain. In some embodiments, a gene modifying polypeptide comprises, in N-terminal to C-terminal order, a first NLS, a DNA binding domain, a linker, an RT domain, and a second NLS, wherein the linker and RT domain are the linker and RT domain of a gene modifying polypeptide of any one of SEQ ID NOs: 1-7743, or an amino acid sequence having at least 70%, 75%, 80%, 85%, 90%, 95%, or 99% identity to said linker and RT domain. In some embodiments, the gene modifying polypeptide further comprises an N-terminal methionine residue.

In some embodiments, the gene modifying polypeptide comprises, in N-terminal to C-terminal order, one or more (e.g., 1, 2, 3, 4, 5, or all 6) of an N-terminal methionine residue, a first nuclear localization signal (NLS) (e.g., of a gene modifying polypeptide of any one of SEQ ID NOs: 1-7743 and/or as listed in any of Tables A1, T1, or T2, or an amino acid sequence having at least 70%, 75%, 80%, 85%, 90%, 95%, or 99% identity thereto), a DNA binding domain (e.g., a Cas domain, e.g., a SpyCas9 domain, e.g., as listed in Table 8, or an amino acid sequence having at least 70%, 75%, 80%, 85%, 90%, 95%, or 99% identity thereto; or a DNA binding domain of a gene modifying polypeptide of any one of SEQ ID NOs: 1-7743 and/or as listed in any of Tables A1, T1, or T2, or an amino acid sequence having at least 70%, 75%, 80%, 85%, 90%, 95%, or 99% identity thereto), a linker (e.g., of a gene modifying polypeptide of any one of SEQ ID NOs: 1-7743 and/or as listed in any of Tables A1, T1, or T2, or an amino acid sequence having at least 70%, 75%, 80%, 85%, 90%, 95%, or 99% identity thereto), an RT domain (e.g., of a gene modifying polypeptide of any one of SEQ ID NOs: 1-7743 and/or as listed in any of Tables A1, T1, or T2, or an amino acid sequence having at least 70%, 75%, 80%, 85%, 90%, 95%, or 99% identity thereto), and a second NLS (e.g., of a gene modifying polypeptide of any one of SEQ ID NOs: 1-7743 and/or as listed in any of Tables A1, T1, or T2, or an amino acid sequence having at least 70%, 75%, 80%, 85%, 90%, 95%, or 99% identity thereto). In some embodiments, the gene modifying polypeptide further comprises (e.g., C-terminal to the second NLS) a T2A sequence and/or a puromycin sequence (e.g., of a gene modifying polypeptide of any one of SEQ ID NOs: 1-7743 and/or as listed in any of Tables A1, T1, or T2, or an amino acid sequence having at least 70%, 75%, 80%, 85%, 90%, 95%, or 99% identity thereto). In some embodiments, a nucleic acid encoding a gene modifying polypeptide (e.g., as described herein) encodes a T2A sequence, e.g., wherein the T2A sequence is situated between a region encoding the gene modifying polypeptide and a second region, wherein the second region optionally encodes a selectable marker, e.g., puromycin.

In certain embodiments, the first NLS comprises a first NLS sequence of a gene modifying polypeptide having an amino acid sequence of any one of SEQ ID NOs: 1-7743, or an amino acid sequence having at least 70%, 75%, 80%, 85%, 90%, 95%, or 99% identity thereto. In certain embodiments, the first NLS comprises a first NLS sequence of a gene modifying polypeptide as listed in any of Tables A1, T1, or T2, or an amino acid sequence having at least 70%, 75%, 80%, 85%, 90%, 95%, or 99% identity thereto. In certain embodiments, the first NLS sequence comprises a C-myc NLS. In certain embodiments, the first NLS comprises the amino acid sequence PAAKRVKLD (SEQ ID NO: 11,095), or an amino acid sequence having at least 70%, 75%, 80%, 85%, 90%, 95%, or 99% identity thereto.

In certain embodiments, the gene modifying polypeptide further comprises a spacer sequence between the first NLS and the DNA binding domain. In certain embodiments, the spacer sequence between the first NLS and the DNA binding domain comprises 1, 2, 3, 4, 5, 6, 7, 8, 9, or 10 amino acids. In certain embodiments, the spacer sequence between the first NLS and the DNA binding domain comprises the amino acid sequence GG.

In certain embodiments, the DNA binding domain comprises a DNA binding domain of a gene modifying polypeptide of any one of SEQ ID NOs: 1-7743, or an amino acid sequence having at least 70%, 75%, 80%, 85%, 90%, 95%, or 99% identity thereto. In certain embodiments, the DNA binding domain comprises a DNA binding domain of a gene modifying polypeptide as listed in any of Tables A1, T1, or T2, or an amino acid sequence having at least 70%, 75%, 80%, 85%, 90%, 95%, or 99% identity thereto. In certain embodiments, the DNA binding domain comprises a Cas domain (e.g., as listed in Table 8). In certain embodiments, the DNA binding domain comprises the amino acid sequence of a SpyCas9 polypeptide (e.g., as listed in Table 8, e.g., a Cas9 N863A polypeptide), or an amino acid sequence having at least 70%, 75%, 80%, 85%, 90%, 95%, or 99% identity thereto. In certain embodiments, the DNA binding domain comprises the amino acid sequence:

```
                                       (SEQ ID NO: 11,096)
DKKYSIGLDIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKARGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGD,
```

or an amino acid sequence having at least 70%, 75%, 80%, 85%, 90%, 95%, or 99% identity thereto.

In certain embodiments, the gene modifying polypeptide further comprises a spacer sequence between the DNA binding domain and the linker. In certain embodiments, the spacer sequence between the DNA binding domain and the linker comprises 1, 2, 3, 4, 5, 6, 7, 8, 9, or 10 amino acids. In certain embodiments, the spacer sequence between the DNA binding domain and the linker comprises the amino acid sequence GG.

In certain embodiments, the linker comprises a linker sequence of a gene modifying polypeptide of any one of SEQ ID NOs: 1-7743, or an amino acid sequence having at least 70%, 75%, 80%, 85%, 90%, 95%, or 99% identity thereto. In certain embodiments, the linker comprises a linker sequence of a gene modifying polypeptide as listed in any of Tables A1, T1, or T2, or an amino acid sequence having at least 70%, 75%, 80%, 85%, 90%, 95%, or 99% identity thereto. In certain embodiments, the linker comprises an amino acid sequence as listed in Table D or 10, or an amino acid sequence having at least 70%, 75%, 80%, 85%, 90%, 95%, or 99% identity thereto.

In certain embodiments, the gene modifying polypeptide further comprises a spacer sequence between the linker and the RT domain. In certain embodiments, the spacer sequence between the linker and the RT domain comprises 1, 2, 3, 4, 5, 6, 7, 8, 9, or 10 amino acids. In certain embodiments, the spacer sequence between the linker and the RT domain comprises the amino acid sequence GG.

In certain embodiments, the RT domain comprises a RT domain sequence of a gene modifying polypeptide of any one of SEQ ID NOs: 1-7743, or an amino acid sequence having at least 70%, 75%, 80%, 85%, 90%, 95%, or 99% identity thereto. In certain embodiments, the RT domain comprises a RT domain sequence of a gene modifying polypeptide as listed in any of Tables A1, T1, or T2, or an amino acid sequence having at least 70%, 75%, 80%, 85%, 90%, 95%, or 99% identity thereto. In certain embodiments, the RT domain comprises an amino acid sequence as listed in Table D or 6, or an amino acid sequence having at least 70%, 75%, 80%, 85%, 90%, 95%, or 99% identity thereto. In some embodiments, the RT domain has a length of about 400-500, 500-600, 600-700, 700-800, 800-900, or 900-1000 amino acids.

In certain embodiments, the gene modifying polypeptide further comprises a spacer sequence between the RT domain and the second NLS. In certain embodiments, the spacer sequence between the RT domain and the second NLS comprises 1, 2, 3, 4, 5, 6, 7, 8, 9, or 10 amino acids. In certain embodiments, the spacer sequence between the RT domain and the second NLS comprises the amino acid sequence AG.

In certain embodiments, the second NLS comprises a second NLS sequence of a gene modifying polypeptide of any one of SEQ ID NOs: 1-7743. In certain embodiments, the second NLS comprises a second NLS sequence of a gene modifying polypeptide as listed in any of Tables A1, T1, or T2. In certain embodiments, the second NLS sequence comprises a plurality of partial NLS sequences. In embodiments, the NLS sequence, e.g., the second NLS sequence, comprises a first partial NLS sequence, e.g., comprising the amino acid sequence KRTADGSEFE (SEQ ID NO: 11,097), or an amino acid sequence having at least 70%, 75%, 80%, 85%, 90%, 95%, or 99% identity thereto. In embodiments, the NLS sequence, e.g., the second NLS sequence, comprises a second partial NLS sequence. In embodiments, the NLS sequence, e.g., the second NLS sequence, comprises an SV40A5 NLS, e.g., a bipartite SV40A5 NLS, e.g., comprising the amino acid sequence KRTADGSEFESPKKKAKVE (SEQ ID NO: 11,098), or an amino acid sequence having at least 70%, 75%, 80%, 85%, 90%, 95%, or 99% identity thereto. In certain embodiments, the NLS sequence, e.g., the second NLS sequence, comprises the amino acid sequence KRTADGSEFEKRTADGSEFESPKKKAKVE (SEQ ID NO: 11,099), or an amino acid sequence having at least 70%, 75%, 80%, 85%, 90%, 95%, or 99% identity thereto.

In certain embodiments, the gene modifying polypeptide further comprises a spacer sequence between the second NLS and the T2A sequence and/or puromycin sequence. In certain embodiments, the spacer sequence between the second NLS and the T2A sequence and/or puromycin sequence comprises 1, 2, 3, 4, 5, 6, 7, 8, 9, or 10 amino acids. In certain embodiments, the spacer sequence between the second NLS and the T2A sequence and/or puromycin sequence comprises the amino acid sequence GSG.

Linkers and RT Domains

In some embodiments, the gene modifying polypeptide comprises a linker (e.g., as described herein) and an RT domain (e.g., as described herein). In certain embodiments, the gene modifying polypeptide comprises, in N-terminal to C-terminal order, a linker (e.g., as described herein) and an RT domain (e.g., as described herein).

In certain embodiments, the linker comprises a linker sequence as listed in Table 10, or an amino acid sequence having at least 70%, 75%, 80%, 85%, 90%, 95%, or 99% identity thereto. In certain embodiments, the linker comprises a linker sequence of any one of SEQ ID NOs: 1-7743, or an amino acid sequence having at least 70%, 75%, 80%, 85%, 90%, 95%, or 99% identity thereto. In certain embodiments, the linker comprises a linker sequence of any one of SEQ ID NOs: 6001-7743, or an amino acid sequence having at least 70%, 75%, 80%, 85%, 90%, 95%, or 99% identity thereto. In certain embodiments, the linker comprises a linker sequence of any one of SEQ ID NOs: 4501-4541, or an amino acid sequence having at least 70%, 75%, 80%, 85%, 90%, 95%, or 99% identity thereto. In certain embodiments, the linker comprises a linker sequence of an exemplary gene modifying polypeptide listed in any of Tables A1, T1, or T2, or an amino acid sequence having at least 70%, 75%, 80%, 85%, 90%, 95%, or 99% identity thereto. In certain embodiments, the RT domain comprises an RT domain sequence as listed in Table 6, or an amino acid sequence having at least 70%, 75%, 80%, 85%, 90%, 95%, or 99% identity thereto. In certain embodiments, the RT domain comprises an RT domain sequence of an exemplary gene modifying polypeptide listed in any of Tables A1, T1, or T2, or an amino acid sequence having at least 70%, 75%, 80%, 85%, 90%, 95%, or 99% identity thereto.

In some embodiments, a gene modifying polypeptide comprises a portion of a gene modifying polypeptide of any one of SEQ ID NOs: 1-7743, wherein the portion comprises a linker and RT domain, or an amino acid sequence having at least 70%, 75%, 80%, 85%, 90%, 95%, or 99% identity to said portion.

In some embodiments, a gene modifying polypeptide comprises a linker of a gene modifying polypeptide of any one of SEQ ID NOs: 1-7743, or an amino acid sequence having at least 70%, 75%, 80%, 85%, 90%, 95%, or 99% identity to said linker. In some embodiments, a gene modifying polypeptide comprises a linker of a gene modifying polypeptide of any one of SEQ ID NOs: 6001-7743, or an amino acid sequence having at least 70%, 75%, 80%, 85%, 90%, 95%, or 99% identity to said linker. In some embodiments, a gene modifying polypeptide comprises a linker of a gene modifying polypeptide of any one of SEQ ID NOs: 4501-4541, or an amino acid sequence having at least 70%, 75%, 80%, 85%, 90%, 95%, or 99% identity to said linker. In some embodiments, a gene modifying polypeptide comprises a linker of a gene modifying polypeptide as listed in any of Tables A1, T1, or T2, or a linker comprising an amino acid sequence having at least 70%, 75%, 80%, 85%, 90%, 95%, or 99% identity thereto.

In some embodiments, a gene modifying polypeptide comprises an RT domain of a gene modifying polypeptide of any one of SEQ ID NOs: 1-7743, or an amino acid sequence having at least 70%, 75%, 80%, 85%, 90%, 95%, or 99% identity to said RT domain. In some embodiments, a gene modifying polypeptide comprises an RT domain of a gene modifying polypeptide of any one of SEQ ID NOs: 6001-7743, or an amino acid sequence having at least 70%, 75%, 80%, 85%, 90%, 95%, or 99% identity said RT domain. In some embodiments, a gene modifying polypeptide comprises an RT domain of a gene modifying polypeptide of any one of SEQ ID NOs: 4501-4541, or an amino acid sequence having at least 70%, 75%, 80%, 85%, 90%, 95%, or 99% identity said RT domain. In some embodiments, a gene modifying polypeptide comprises an RT domain of a gene modifying polypeptide as listed in any of Tables A1, T1, or T2, or an RT domain comprising an amino acid sequence having at least 70%, 75%, 80%, 85%, 90%, 95%, or 99% identity thereto.

In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) of a gene modifying polypeptide having the amino acid sequence of any one of SEQ ID NOs: 1-7743. In certain embodiments, the linker and the RT domain of a gene modifying polypeptide comprise amino acid sequences of a linker and RT domain having at least 80% identity to the linker and RT domains of any one of SEQ ID NOs: 1-7743. In certain embodiments, the linker and the RT domain of a gene modifying polypeptide comprise amino acid sequences of a linker and RT domain having at least 90% identity to the linker and RT domains of any one of SEQ ID NOs: 1-7743. In certain embodiments, the linker and the RT domain of a gene modifying polypeptide comprise amino acid sequences of a linker and RT domain having at least 95% identity to the linker and RT domains of any one of SEQ ID NOs: 1-7743. In certain embodiments, the linker and the RT domain of a gene modifying polypeptide comprise amino acid sequences of a linker and RT domain having at least 99% identity to the linker and RT domains of any one of SEQ ID NOs: 1-7743. In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) of a gene modifying polypeptide having the amino acid sequence of any one of SEQ ID NOs: 6001-7743. In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) of a gene modifying polypeptide having the amino acid sequence of any one of SEQ ID NOs: 4501-4541. In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) from a single row of any of Tables A1, T1, or T2 (e.g., from a single exemplary gene modifying polypeptide as listed in any of Tables A1, T1, or T2).

In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) from two different amino acid sequences selected from SEQ ID NOs: 1-7743. In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) from different rows of any of Tables A1, T1, or T2.

In certain embodiments, the gene modifying polypeptide further comprises a first NLS (e.g., a 5' NLS), e.g., as described herein. In certain embodiments, the gene modifying polypeptide further comprises a second NLS (e.g., a 3' NLS), e.g., as described herein. In certain embodiments, the gene modifying polypeptide further comprises an N-terminal methionine residue.

RT Families and Mutants

In certain embodiments, a gene modifying polypeptide comprises comprises the amino acid sequence of an RT domain sequence from a family selected from: AVIRE, BAEVM, FFV, FLY, FOAMY, GALV, KORV, MLVAV, MLVBM, MLVCB, MLVFF, MLVMS, PERV, SFV1, SFV3L, WMSV, XMRV6, BLVAU, BLVJ, HTL1A, HTL1C, HTL1L, HTL32, HTL3P, HTLV2, JSRV, MLVFS, MLVRD, MMTVB, MPMV, SFVCP, SMRVH, SRV1, SRV2, and WDSV. In certain embodiments, a gene modifying polypeptide comprises comprises the amino acid sequence of an RT domain sequence from a family selected from: AVIRE, BAEVM, FFV, FLY, FOAMY, GALV, KORV, MLVAV, MLVBM, MLVCB, MLVFF, MLVMS, PERV, SFV1, SFV3L, WMSV, and XMRV6.

In certain embodiments, a gene modifying polypeptide comprises comprises the amino acid sequence of an RT domain sequence from an MLVMS RT domain. In embodiments, the amino acid sequence of an RT domain sequence comprises one or more point mutations as listed in column 1 of Table M1, or a point mutation corresponding thereto. In embodiments, the amino acid sequence of an RT domain sequence comprises one or more point mutations as listed in column 3 of Table M1 (Gen1 MLVMS), or a point mutation corresponding thereto. In embodiments, the amino acid sequence of an RT domain sequence comprises one or more point mutations at an amino acid position of the RT domain as listed in columns 1 and 2 of Table M2, or an amino acid position corresponding thereto.

In certain embodiments, a gene modifying polypeptide comprises comprises the amino acid sequence of an RT domain sequence from an AVIRE RT domain. In embodiments, the amino acid sequence of an RT domain sequence comprises one or more point mutations as listed in column 2 of Table M1, or a point mutation corresponding thereto. In embodiments, the amino acid sequence of an RT domain sequence comprises one or more point mutations as listed in column 4 of Table M1 (Gen2 AVIRE), or a point mutation corresponding thereto. In embodiments, the amino acid sequence of an RT domain sequence comprises one or more point mutations at an amino acid position of the RT domain as listed in columns 3 and 4 of Table M2, or an amino acid position corresponding thereto. In certain embodiments, the RT domain comprises an IENSSP (SEQ ID NO: 37639) (e.g., at the C-terminus).

TABLE M1

Exemplary point mutations in MLVMS and AVIRE RT domains

| RT-linker filing (MLVMS) | Corresponding AVIRE | Gen1 MLVMS (PLV4921) | Gen2 AVIRE (PLV10990) |
|---|---|---|---|
| | | H8Y | |
| P51L | Q51L | | |
| S67R | T67R | | |
| E67K | E67K | | |
| E69K | E69K | | |
| T197A | T197A | | |
| D200N | D200N | D200N | D200N |
| H204R | N204R | | |
| E302K | E302K | | |
| | | T306K | T306K |
| F309N | Y309N | | |
| W313F | W313F | W313F | W313F |
| T330P | G330P | T330P | G330P |
| L435G | T436G | | |

TABLE M1-continued

| Exemplary point mutations in MLVMS and AVIRE RT domains | | | |
|---|---|---|---|
| RT-linker filing (MLVMS) | Corresponding AVIRE | Gen1 MLVMS (PLV4921) | Gen2 AVIRE (PLV10990) |
| N454K | N455K | | |
| D524G | D526G | | |
| E562Q | E564Q | | |
| D583N | D585N | | |
| H594Q | H596Q | | |
| L603W | L605W | L603W | L605W |
| D653N | D655N | | |
| L671P | L673P | | |
| | | IENSSP (SEQ ID NO: 37639) at C-term | |

TABLE M2

| Positions that can be mutated in exemplary MLVMS and AVIRE RT domains WT residue & position | | | |
|---|---|---|---|
| MLVMS aa | MLVMS position # * | AVIRE aa | AVIRE position # * |
| H | 8 | Y | 8 |
| P | 51 | Q | 51 |
| S | 67 | T | 67 |
| E | 69 | E | 69 |
| T | 197 | T | 197 |
| D | 200 | D | 200 |
| H | 204 | N | 204 |
| E | 302 | E | 302 |
| T | 306 | T | 306 |
| F | 309 | Y | 309 |
| W | 313 | W | 313 |
| T | 330 | G | 330 |
| L | 435 | T | 436 |
| N | 454 | N | 455 |
| D | 524 | D | 526 |
| E | 562 | E | 564 |
| D | 583 | D | 585 |
| H | 594 | H | 596 |
| L | 603 | L | 605 |
| D | 653 | D | 655 |
| L | 671 | S | 673 |

In certain embodiments, a gene modifying polypeptide comprises a gamma retrovirus derived RT domain. In certain embodiments, the gamma retrovirus-derived RT domain of a gene modifying polypeptide comprises the amino acid sequence of an RT domain sequence from a family selected from: AVIRE, BAEVM, FFV, FLY, FOAMY, GALV, KORV, MLVAV, MLVBM, MLVCB, MLVFF, MLVMS, PERV, SFV1, SFV3L, WMSV, and XMRV6. In some embodiments, the gamma retrovirus-derived RT domain of a gene modifying polypeptide is not derived from PERV. In some embodiments, said RT includes one, two, three, four, five, six or more mutations shown in Table 2 and corresponding to mutations D200N, L603W, T330P, D524G, E562Q, D583N, P51L, S67R, E67K, T197A, H204R, E302K, F309N, W313F, L435G, N454K, H594Q, L671P, E69K, or D653N in the RT domain of murine leukemia virus reverse transcriptase. In some embodiments, the gene modifying polypeptide further comprises a linker having at least 99% identity to a linker domains of any one of SEQ ID NOs: 1-7743. In some embodiments, the gene modifying polypeptide further comprises a linker having at least 99% or 100% identity to SEQ ID NO: 5217 or SEQ ID NO:11,041.

In embodiments, the RT domain comprises the amino acid sequence of an RT domain of an AVIRE RT (e.g., an AVIRE P03360 sequence, e.g., SEQ ID NO: 8001), or an amino acid sequence having at least 70%, 75%, 80%, 85%, 90%, 95%, or 99% identity thereto. In some embodiments, the RT domain comprises the amino acid sequence of an AVIRE RT further comprising one, two, three, four, or five mutations selected from the group consisting of D200N, G330P, L605W, T306K, and W313F, or a corresponding position in a homologous RT domain. In some embodiments, the RT domain comprises the amino acid sequence of an AVIRE RT further comprising one, two, or three mutations selected from the group consisting of D200N, G330P, and L605W, or a corresponding position in a homologous RT domain.

In embodiments, the RT domain comprises the amino acid sequence of an RT domain of a BAEVM RT (e.g., an BAEVM_P10272 sequence, e.g., SEQ ID NO: 8004), or an amino acid sequence having at least 70%, 75%, 80%, 85%, 90%, 95%, or 99% identity thereto. In some embodiments, the RT domain comprises the amino acid sequence of a BAEVM RT further comprising one, two, three, four, or five mutations selected from the group consisting of D198N, E328P, L602W, T304K, and W311F, or a corresponding position in a homologous RT domain. In some embodiments, the RT domain comprises the amino acid sequence of a BAEVM RT further comprising one, two, or three mutations selected from the group consisting of D198N, E328P, and L602W, or a corresponding position in a homologous RT domain.

In embodiments, the RT domain comprises the amino acid sequence of an RT domain of an FFV RT (e.g., an FFV_O93209 sequence, e.g., SEQ ID NO: 8012), or an amino acid sequence having at least 70%, 75%, 80%, 85%, 90%, 95%, or 99% identity thereto. In some embodiments, the RT domain comprises the amino acid sequence of an FFV RT further comprising one, two, three, or four mutations selected from the group consisting of D21N, T293N, T419P, and L393K, or a corresponding position in a homologous RT domain. In some embodiments, the RT domain comprises the amino acid sequence of an FFV RT further comprising one, two, or three mutations selected from the group consisting of D21N, T293N, and T419P, or a corresponding position in a homologous RT domain. In some embodiments, the RT domain comprises the amino acid sequence of an FFV RT further comprising the mutation D21N. In some embodiments, the RT domain comprises the amino acid sequence of an FFV RT further comprising one, two, or three mutations selected from the group consisting of T207N, T333P, and L307K, or a corresponding position in a homologous RT domain. In some embodiments, the RT domain comprises the amino acid sequence of an FFV RT further comprising one or two mutations selected from the group consisting of T207N and T333P, or a corresponding position in a homologous RT domain.

In embodiments, the RT domain comprises the amino acid sequence of an RT domain of an FLV RT (e.g., an FLV_P10273 sequence, e.g., SEQ ID NO: 8019), or an amino acid sequence having at least 70%, 75%, 80%, 85%, 90%, 95%, or 99% identity thereto. In some embodiments, the RT domain comprises the amino acid sequence of an FLV RT further comprising one, two, three, or four mutations selected from the group consisting of D199N, L602W, T305K, and W312F, or a corresponding position in a homologous RT domain. In some embodiments, the RT domain comprises the amino acid sequence of an FLV RT further comprising one or two mutations selected from the group consisting of D199N and L602W, or a corresponding position in a homologous RT domain.

In embodiments, the RT domain comprises the amino acid sequence of an RT domain of a FOAMV RT (e.g., an FOAMV_P14350 sequence, e.g., SEQ ID NO: 8021), or an amino acid sequence having at least 70%, 75%, 80%, 85%, 90%, 95%, or 99% identity thereto. In some embodiments, the RT domain comprises the amino acid sequence of an FOAMV RT further comprising one, two, three, or four mutations selected from the group consisting of D24N, T296N, S420P, and L396K, or a corresponding position in a homologous RT domain. In some embodiments, the RT domain comprises the amino acid sequence of an FOAMV RT further comprising one, two, or three mutations selected from the group consisting of D24N, T296N, and S420P, or a corresponding position in a homologous RT domain. In some embodiments, the RT domain comprises the amino acid sequence of an FOAMV RT further comprising the mutation D24N, or a corresponding position in a homologous RT domain. In some embodiments, the RT domain comprises the amino acid sequence of an FOAMV RT further comprising one, two, or three mutations selected from the group consisting of T207N, S331P, and L307K, or a corresponding position in a homologous RT domain. In some embodiments, the RT domain comprises the amino acid sequence of an FOAMV RT further comprising one or two mutations selected from the group consisting of T207N and S331P, or a corresponding position in a homologous RT domain.

In embodiments, the RT domain comprises the amino acid sequence of an RT domain of a GALV RT (e.g., an GALV_P21414 sequence, e.g., SEQ ID NO: 8027), or an amino acid sequence having at least 70%, 75%, 80%, 85%, 90%, 95%, or 99% identity thereto. In some embodiments, the RT domain comprises the amino acid sequence of a GALV RT further comprising one, two, three, four, or five mutations selected from the group consisting of D198N, E328P, L600W, T304K, and W311F, or a corresponding position in a homologous RT domain. In some embodiments, the RT domain comprises the amino acid sequence of a GALV RT further comprising one, two, or three mutations selected from the group consisting of D198N, E328P, and L600W, or a corresponding position in a homologous RT domain.

In embodiments, the RT domain comprises the amino acid sequence of an RT domain of a KORV RT (e.g., an KORV_Q9TTC1 sequence, e.g., SEQ ID NO: 8047), or an amino acid sequence having at least 70%, 75%, 80%, 85%, 90%, 95%, or 99% identity thereto. In some embodiments, the RT domain comprises the amino acid sequence of a GALV RT further comprising one, two, three, four, five, or six mutations selected from the group consisting of D32N, D322N, E452P, L274W, T428K, and W435F, or a corresponding position in a homologous RT domain. In some embodiments, the RT domain comprises the amino acid sequence of a GALV RT further comprising one, two, three, or four mutations selected from the group consisting of D32N, D322N, E452P, and L274W, or a corresponding position in a homologous RT domain. In some embodiments, the RT domain comprises the amino acid sequence of a GALV RT further comprising the mutation D32N. In some embodiments, the RT domain comprises the amino acid sequence of a KORV RT further comprising one, two, three, four, or five mutations selected from the group consisting of D231N, E361P, L633W, T337K, and W344F, or a corresponding position in a homologous RT domain. In some embodiments, the RT domain comprises the amino acid sequence of a KORV RT further comprising one, two, or three mutations selected from the group consisting of D231N, E361P, and L633W, or a corresponding position in a homologous RT domain.

In embodiments, the RT domain comprises the amino acid sequence of an RT domain of a MLVAV RT (e.g., an MLVAV_P03356 sequence, e.g., SEQ ID NO: 8053), or an amino acid sequence having at least 70%, 75%, 80%, 85%, 90%, 95%, or 99% identity thereto. In some embodiments, the RT domain comprises the amino acid sequence of a MLVAV RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a MLVAV RT further comprising one, two, or three mutations selected from the group consisting of D200N, T330P, and L603W, or a corresponding position in a homologous RT domain.

In embodiments, the RT domain comprises the amino acid sequence of an RT domain of a MLVBM RT (e.g., an MLVBM_Q7SVK7 sequence, e.g., SEQ ID NO: 8056), or an amino acid sequence having at least 70%, 75%, 80%, 85%, 90%, 95%, or 99% identity thereto. In some embodiments, the RT domain comprises the amino acid sequence of a MLVBM RT further comprising one, two, three, four, or five mutations selected from the group consisting of D199N, T329P, L602W, T305K, and W312F, or a corresponding position in a homologous RT domain. In some embodiments, the RT domain comprises the amino acid sequence of a MLVBM RT further comprising one, two, and three mutations selected from the group consisting of D200N, T330P, and L603W, or a corresponding position in a homologous RT domain.

In embodiments, the RT domain comprises the amino acid sequence of an RT domain of a MLVCB RT (e.g., an MLVCB_P08361 sequence, e.g., SEQ ID NO: 8062), or an amino acid sequence having at least 70%, 75%, 80%, 85%, 90%, 95%, or 99% identity thereto. In some embodiments, the RT domain comprises the amino acid sequence of a MLVCB RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a MLVCB RT further comprising one, two, and three mutations selected from the group consisting of D200N, T330P, and L603W, or a corresponding position in a homologous RT domain.

In embodiments, the RT domain comprises the amino acid sequence of an RT domain of a MLVFF RT, or an amino acid sequence having at least 70%, 75%, 80%, 85%, 90%, 95%, or 99% identity thereto. In some embodiments, the RT domain comprises the amino acid sequence of a MLVFF RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a MLVFF RT further comprising one, two, and three mutations selected from the group consisting of D200N, T330P, and L603W, or a corresponding position in a homologous RT domain.

In embodiments, the RT domain comprises the amino acid sequence of an RT domain of a MLVMS RT (e.g., an MLVMS reference sequence, e.g., SEQ ID NO: 8137; or an MLVMS_P03355 sequence, e.g., SEQ ID NO: 8070), or an amino acid sequence having at least 70%, 75%, 80%, 85%, 90%, 95%, or 99% identity thereto. In some embodiments, the RT domain comprises the amino acid sequence of a MLVMS RT further comprising one, two, three, four, five, or six mutations selected from the group consisting of D200N, T330P, L603W, T306K, W313F, and H8Y, or a corresponding position in a homologous RT domain. In some embodiments, the RT domain comprises the amino acid sequence of a MLVMS RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a MLVMS RT further comprising one, two, or three mutations selected from the group consisting of D200N, T330P, and L603W, or a corresponding position in a homologous RT domain.

In embodiments, the RT domain comprises the amino acid sequence of an RT domain of a PERV RT (e.g., an PERV_Q4VFZ2 sequence, e.g., SEQ ID NO: 8099), or an amino acid sequence having at least 70%, 75%, 80%, 85%, 90%, 95%, or 99% identity thereto. In some embodiments, the RT domain comprises the amino acid sequence of a PERV RT further comprising one, two, three, four, or five mutations selected from the group consisting of D196N, E326P, L599W, T302K, and W309F, or a corresponding position in a homologous RT domain. In some embodiments, the RT domain comprises the amino acid sequence of a PERV RT further comprising one, two, or three mutations selected from the group consisting of D196N, E326P, and L599W, or a corresponding position in a homologous RT domain.

In embodiments, the RT domain comprises the amino acid sequence of an RT domain of a SFV1 RT (e.g., an SFV1_P23074 sequence, e.g., SEQ ID NO: 8105), or an amino acid sequence having at least 70%, 75%, 80%, 85%, 90%, 95%, or 99% identity thereto. In some embodiments, the RT domain comprises the amino acid sequence of a SFV1 RT further comprising one, two, three, or four mutations selected from the group consisting of D24N, T296N, N420P, and L396K, or a corresponding position in a homologous RT domain. In some embodiments, the RT domain comprises the amino acid sequence of a SFV1 RT further comprising one, two, or three mutations selected from the group consisting of D24N, T296N, and N420P, or a corresponding position in a homologous RT domain. In some embodiments, the RT domain comprises the amino acid sequence of a SFV1 RT further comprising the D24N, or a corresponding position in a homologous RT domain.

In embodiments, the RT domain comprises the amino acid sequence of an RT domain of a SFV3L RT (e.g., an SFV3L_P27401 sequence, e.g., SEQ ID NO: 8111), or an amino acid sequence having at least 70%, 75%, 80%, 85%, 90%, 95%, or 99% identity thereto. In some embodiments, the RT domain comprises the amino acid sequence of a SFV3L RT further comprising one, two, three, or four mutations selected from the group consisting of D24N, T296N, N422P, and L396K, or a corresponding position in a homologous RT domain. In some embodiments, the RT domain comprises the amino acid sequence of a SFV3L RT further comprising one, two, or three mutations selected from the group consisting of D24N, T296N, and N422P, or a corresponding position in a homologous RT domain. In some embodiments, the RT domain comprises the amino acid sequence of a SFV3L RT further comprising the mutation D24N, or a corresponding position in a homologous RT domain. In some embodiments, the RT domain comprises the amino acid sequence of a SFV3L RT further comprising one, two, or three mutations selected from the group consisting of T307N, N333P, and L307K, or a corresponding position in a homologous RT domain. In some embodiments, the RT domain comprises the amino acid sequence of a SFV3L RT further comprising one or two mutations selected from the group consisting of T307N and N333P, or a corresponding position in a homologous RT domain.

In embodiments, the RT domain comprises the amino acid sequence of an RT domain of a WMSV RT (e.g., an WMSV_P03359 sequence, e.g., SEQ ID NO: 8131), or an amino acid sequence having at least 70%, 75%, 80%, 85%, 90%, 95%, or 99% identity thereto. In some embodiments, the RT domain comprises the amino acid sequence of a WMSV RT further comprising one, two, three, four, or five mutations selected from the group consisting of D198N, E328P, L600W, T304K, and W311F, or a corresponding position in a homologous RT domain. In some embodiments, the RT domain comprises the amino acid sequence of a WMSV RT further comprising one, two, or three mutations selected from the group consisting of D198N, E328P, and L600W, or a corresponding position in a homologous RT domain.

In embodiments, the RT domain comprises the amino acid sequence of an RT domain of a XMRV6 RT (e.g., an XMRV6_A1Z651 sequence, e.g., SEQ ID NO: 8134), or an amino acid sequence having at least 70%, 75%, 80%, 85%, 90%, 95%, or 99% identity thereto. In some embodiments, the RT domain comprises the amino acid sequence of a XMRV6 RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a XMRV6 RT further comprising one, two, or three mutations selected from the group consisting of D200N, T330P, and L603W, or a corresponding position in a homologous RT domain.

In certain embodiments, the RT domain of a gene modifying polypeptide comprises the amino acid sequence of an RT domain of an AVIRE RT, or an amino acid sequence having at least 70%, 75%, 80%, 85%, 90%, 95%, or 99% identity thereto. In embodiments, the RT domain comprises the amino acid sequence of an RT domain comprised in a sequence listed in column 1 of Table A5, or an amino acid sequence having at least 70%, 75%, 80%, 85%, 90%, 95%, or 99% identity thereto. In some embodiments, the gene modifying polypeptide further comprises a linker having at least 99% or 100% identity to SEQ ID NO: 5217 or SEQ ID NO:11,041.

In certain embodiments, the RT domain of a gene modifying polypeptide comprises the amino acid sequence of an RT domain of an MLVMS RT, or an amino acid sequence having at least 70%, 75%, 80%, 85%, 90%, 95%, or 99% identity thereto. In embodiments, the RT domain comprises the amino acid sequence of an RT domain comprised in a sequence listed in any of columns 2-6 of Table A5, or an amino acid sequence having at least 70%, 75%, 80%, 85%, 90%, 95%, or 99% identity thereto. In some embodiments, the gene modifying polypeptide further comprises a linker having at least 99% or 100% identity to SEQ ID NO: 5217 or SEQ ID NO:11,041.

TABLE A5

Exemplary gene modifying polypeptides comprising an AVIRE RT domain or an MLVMS RT domain.

| AVIRE SEQ ID NOs: | MLVMS SEQ ID NOs: | | | | |
|---|---|---|---|---|---|
| 1 | 2704 | 3007 | 3038 | 2638 | 2930 |
| 2 | 2706 | 3007 | 3038 | 2639 | 2930 |
| 3 | 2708 | 3008 | 3039 | 2639 | 2931 |
| 4 | 2709 | 3008 | 3039 | 2640 | 2931 |
| 5 | 2709 | 3009 | 3040 | 2640 | 2932 |
| 6 | 2710 | 3010 | 3040 | 2641 | 2932 |
| 7 | 2957 | 3010 | 3041 | 2641 | 2933 |
| 9 | 2957 | 3011 | 3041 | 2642 | 2933 |
| 10 | 2958 | 3012 | 3042 | 2642 | 2934 |
| 12 | 2959 | 3012 | 3042 | 2643 | 2934 |
| 13 | 2960 | 3013 | 3043 | 2643 | 2935 |
| 14 | 2962 | 3013 | 3043 | 2644 | 2935 |
| 6076 | 6042 | 3014 | 3044 | 2644 | 2936 |
| 6143 | 6068 | 3014 | 3044 | 2645 | 2936 |
| 6200 | 6097 | 3015 | 3045 | 2645 | 2937 |
| 6254 | 6136 | 3015 | 3045 | 2646 | 2937 |
| 6274 | 6156 | 3016 | 3046 | 2646 | 2938 |
| 6315 | 6215 | 3016 | 3046 | 2647 | 2938 |
| 6328 | 6216 | 3017 | 3047 | 2647 | 2939 |
| 6337 | 6301 | 3018 | 3047 | 2648 | 2939 |
| 6403 | 6352 | 3018 | 3048 | 2648 | 2940 |
| 6420 | 6365 | 3019 | 3048 | 2649 | 2940 |
| 6440 | 6411 | 3019 | 3049 | 2649 | 2941 |
| 6513 | 6436 | 3020 | 3049 | 2650 | 2941 |
| 6552 | 6458 | 3020 | 3050 | 2650 | 2942 |
| 6613 | 6459 | 3021 | 3051 | 2651 | 2942 |
| 6671 | 6524 | 3021 | 3051 | 2651 | 2943 |
| 6822 | 6562 | 3022 | 3052 | 2652 | 2943 |
| 6840 | 6563 | 3023 | 3052 | 2652 | 2944 |
| 6884 | 6699 | 3023 | 3053 | 2653 | 2945 |
| 6907 | 6865 | 3024 | 3053 | 2653 | 2945 |
| 6970 | 7022 | 3024 | 3054 | 2654 | 2946 |
| 7025 | 7037 | 3025 | 3054 | 2655 | 2946 |
| 7052 | 7088 | 3025 | 3055 | 2655 | 2947 |
| 7078 | 7116 | 3026 | 3055 | 2656 | 2947 |
| 7243 | 7175 | 3026 | 3056 | 2656 | 2948 |
| 7253 | 7200 | 3027 | 3056 | 2657 | 2948 |
| 7318 | 7206 | 3027 | 3057 | 2657 | 2949 |
| 7379 | 7277 | 3028 | 3057 | 2658 | 2949 |
| 7486 | 7294 | 3028 | 3058 | 2658 | 2950 |
| 7524 | 7330 | 3029 | 3058 | 2659 | 2950 |
| 7668 | 7411 | 3030 | 3059 | 2659 | 2951 |
| 7680 | 7455 | 3030 | 3059 | 2660 | 2951 |
| 7720 | 7477 | 3031 | 3060 | 2660 | 2952 |
| 1137 | 7511 | 3031 | 3060 | 2661 | 2952 |
| 1138 | 7538 | 3032 | 3061 | 2661 | 2953 |
| 1139 | 7559 | 3032 | 3061 | 2662 | 2953 |
| 1140 | 7560 | 3033 | 3062 | 2662 | 2954 |
| 1141 | 7593 | 3033 | 3062 | 2663 | 2954 |
| 1142 | 7594 | 3034 | 3063 | 2663 | 2955 |
| 1143 | 7607 | 3034 | 3063 | 2664 | 2955 |
| 1144 | 7623 | 6025 | 3064 | 2664 | 6485 |
| 1145 | 7638 | 6041 | 3064 | 2665 | 6486 |
| 1146 | 7717 | 6043 | 3065 | 2665 | 6504 |
| 1147 | 7731 | 6098 | 3065 | 2666 | 6505 |
| 1148 | 7732 | 6099 | 3066 | 2666 | 6595 |
| 1149 | 2711 | 6180 | 3066 | 2667 | 6596 |
| 1150 | 2711 | 6182 | 3067 | 2667 | 6751 |
| 1151 | 2712 | 6237 | 3067 | 2668 | 6752 |
| 1152 | 2712 | 6238 | 3068 | 2668 | 6777 |
| 1153 | 2713 | 6311 | 3068 | 2669 | 6778 |
| 1154 | 2713 | 6312 | 3069 | 2669 | 7172 |
| 1155 | 2714 | 6578 | 3069 | 2670 | 7174 |
| 1156 | 2714 | 6579 | 3070 | 2670 | 7313 |
| 1157 | 2715 | 6663 | 3070 | 2671 | 7314 |
| 1158 | 2715 | 6664 | 3071 | 2671 | |
| 1159 | 2716 | 6708 | 3071 | 2672 | |
| 1160 | 2716 | 6709 | 3072 | 2672 | |
| 1161 | 2717 | 6809 | 3072 | 2673 | |
| 1162 | 2717 | 6831 | 3073 | 2673 | |
| 1163 | 2718 | 6832 | 3073 | 2674 | |
| 1164 | 2718 | 6864 | 3074 | 2674 | |
| 1165 | 2719 | 6866 | 3074 | 2675 | |
| 1166 | 2719 | 7089 | 3075 | 2675 | |
| 1167 | 2720 | 7157 | 3075 | 2676 | |

TABLE A5-continued

| Exemplary gene modifying polypeptides comprising an AVIRE RT domain or an MLVMS RT domain. | | | | |
|---|---|---|---|---|
| AVIRE SEQ ID NOs: | | MLVMS SEQ ID NOs: | | |
| 6015 | 2720 | 7159 | 3076 | 2676 |
| 6029 | 2721 | 7173 | 3076 | 2677 |
| 6045 | 2721 | 7176 | 3077 | 2677 |
| 6077 | 2722 | 7293 | 3077 | 2678 |
| 6129 | 2722 | 7295 | 3078 | 2678 |
| 6144 | 2723 | 7343 | 3078 | 2679 |
| 6164 | 2723 | 7393 | 3079 | 2680 |
| 6201 | 2724 | 7394 | 3079 | 2680 |
| 6227 | 2724 | 7425 | 3080 | 2681 |
| 6244 | 2725 | 7426 | 3080 | 2681 |
| 6250 | 2725 | 7444 | 3081 | 2682 |
| 6264 | 2726 | 7445 | 3081 | 2682 |
| 6289 | 2726 | 7476 | 3082 | 2683 |
| 6304 | 2727 | 7478 | 3082 | 2683 |
| 6316 | 2727 | 7496 | 3083 | 2684 |
| 6384 | 2728 | 7497 | 3083 | 2684 |
| 6421 | 2728 | 7537 | 3084 | 2685 |
| 6441 | 2729 | 7539 | 3084 | 2685 |
| 6492 | 2729 | 2780 | 3085 | 2686 |
| 6514 | 2730 | 2780 | 3085 | 2686 |
| 6530 | 2730 | 2781 | 3086 | 2687 |
| 6569 | 2731 | 2781 | 3086 | 2687 |
| 6584 | 2731 | 2782 | 3087 | 2688 |
| 6621 | 2732 | 2782 | 3087 | 2688 |
| 6651 | 2732 | 2783 | 3088 | 2689 |
| 6659 | 2733 | 2783 | 3088 | 2689 |
| 6683 | 2734 | 2784 | 3089 | 2690 |
| 6703 | 2734 | 2784 | 3089 | 2690 |
| 6727 | 2735 | 2785 | 3090 | 2691 |
| 6732 | 2735 | 2785 | 3090 | 2692 |
| 6745 | 2736 | 2786 | 3091 | 2692 |
| 6755 | 2736 | 2786 | 3091 | 2693 |
| 6784 | 2737 | 2787 | 3092 | 2693 |
| 6817 | 2737 | 2787 | 3092 | 2694 |
| 6823 | 2738 | 2788 | 3093 | 2694 |
| 6841 | 2739 | 2788 | 3093 | 2695 |
| 6871 | 2740 | 2789 | 3094 | 2695 |
| 6885 | 2740 | 2789 | 3095 | 2696 |
| 6898 | 2741 | 2790 | 3095 | 2696 |
| 6908 | 2741 | 2790 | 3096 | 2697 |
| 6933 | 2742 | 2791 | 3096 | 2697 |
| 6971 | 2742 | 2791 | 3097 | 2698 |
| 7009 | 2743 | 2792 | 3097 | 2698 |
| 7018 | 2743 | 2792 | 3098 | 2699 |
| 7045 | 2744 | 2793 | 3098 | 2699 |
| 7053 | 2744 | 2793 | 3099 | 2700 |
| 7068 | 2745 | 2794 | 3099 | 2700 |
| 7079 | 2745 | 2794 | 3100 | 2701 |
| 7096 | 2746 | 2795 | 3100 | 2701 |
| 7104 | 2746 | 2795 | 3101 | 2702 |
| 7122 | 2747 | 2796 | 3101 | 2702 |
| 7151 | 2747 | 2796 | 3102 | 2703 |
| 7163 | 2748 | 2797 | 3102 | 2703 |
| 7181 | 2748 | 2797 | 3103 | 2862 |
| 7244 | 2749 | 2798 | 3103 | 2862 |
| 7273 | 2750 | 2798 | 3104 | 2863 |
| 7319 | 2750 | 2799 | 3104 | 2863 |
| 7336 | 2751 | 2799 | 3105 | 2864 |
| 7380 | 2751 | 2800 | 3105 | 2864 |
| 7402 | 2752 | 2800 | 3106 | 2865 |
| 7462 | 2752 | 2801 | 3106 | 2865 |
| 7487 | 2753 | 2801 | 3107 | 2866 |
| 7525 | 2753 | 2802 | 3107 | 2866 |
| 7569 | 2754 | 2802 | 3108 | 2867 |
| 7626 | 2754 | 2803 | 3108 | 2867 |
| 7689 | 2755 | 2803 | 3109 | 2868 |
| 7707 | 2755 | 2804 | 3109 | 2868 |
| 7721 | 2756 | 2804 | 3110 | 2869 |
| 1371 | 2756 | 2805 | 3110 | 2869 |
| 1372 | 2757 | 2805 | 3111 | 2870 |
| 1373 | 2758 | 2806 | 3111 | 2870 |
| 1374 | 2758 | 2806 | 3112 | 2871 |
| 1375 | 2759 | 2807 | 3112 | 2871 |
| 1376 | 2759 | 2807 | 3113 | 2872 |
| 1377 | 2760 | 2808 | 3113 | 2872 |

TABLE A5-continued

Exemplary gene modifying polypeptides comprising an AVIRE RT domain or an MLVMS RT domain.

| AVIRE SEQ ID NOs: | MLVMS SEQ ID NOs: | | | |
|---|---|---|---|---|
| 1378 | 2760 | 2808 | 3114 | 2873 |
| 1379 | 2761 | 2809 | 3114 | 2873 |
| 1380 | 2761 | 2809 | 3115 | 2874 |
| 1381 | 2762 | 2810 | 3115 | 2874 |
| 1382 | 2762 | 2810 | 3116 | 2875 |
| 1383 | 2763 | 2811 | 3116 | 2875 |
| 1384 | 2763 | 2811 | 3117 | 2876 |
| 1385 | 2764 | 2812 | 3117 | 2876 |
| 1386 | 2764 | 2812 | 3118 | 2877 |
| 1387 | 2765 | 2813 | 3118 | 2877 |
| 1388 | 2765 | 2813 | 3119 | 2878 |
| 1389 | 2766 | 2814 | 3119 | 2878 |
| 1390 | 2766 | 2814 | 3120 | 2879 |
| 1391 | 2767 | 2815 | 3120 | 2879 |
| 1392 | 2767 | 2815 | 3121 | 2880 |
| 1393 | 2768 | 2816 | 3121 | 2880 |
| 1394 | 2768 | 2816 | 3122 | 2881 |
| 1395 | 2769 | 2817 | 3122 | 2881 |
| 1396 | 2769 | 2817 | 3123 | 2882 |
| 1397 | 2770 | 2818 | 3123 | 2882 |
| 1398 | 2770 | 2818 | 3124 | 2883 |
| 1399 | 2771 | 2819 | 3124 | 2883 |
| 1400 | 2771 | 2819 | 3125 | 2884 |
| 1401 | 2772 | 2820 | 3125 | 2884 |
| 1402 | 2773 | 2820 | 3126 | 2885 |
| 1403 | 2773 | 2821 | 3126 | 2885 |
| 1404 | 2774 | 2821 | 3127 | 2886 |
| 1405 | 2774 | 2822 | 3127 | 2886 |
| 1406 | 2775 | 2822 | 3128 | 2887 |
| 1407 | 2775 | 2823 | 3128 | 2887 |
| 1408 | 2776 | 2823 | 3129 | 2888 |
| 1409 | 2776 | 2824 | 3129 | 2888 |
| 1410 | 2777 | 2824 | 3130 | 2889 |
| 1411 | 2777 | 2825 | 3130 | 2889 |
| 1412 | 2778 | 2825 | 3131 | 2890 |
| 1413 | 2779 | 2826 | 3131 | 2890 |
| 1414 | 2779 | 2826 | 3132 | 2891 |
| 1415 | 2965 | 2827 | 3133 | 2891 |
| 1416 | 2965 | 2827 | 3133 | 2892 |
| 1417 | 2966 | 2828 | 3134 | 2893 |
| 1418 | 2966 | 2828 | 3134 | 2893 |
| 1419 | 2967 | 2829 | 3135 | 2894 |
| 1420 | 2968 | 2829 | 3135 | 2894 |
| 1421 | 2968 | 2830 | 3136 | 2895 |
| 1422 | 2969 | 2830 | 3136 | 2895 |
| 1423 | 2969 | 2831 | 6181 | 2896 |
| 1424 | 2970 | 2831 | 6183 | 2896 |
| 1425 | 2970 | 2832 | 6284 | 2897 |
| 1426 | 2971 | 2832 | 6285 | 2897 |
| 1427 | 2971 | 2833 | 6760 | 2898 |
| 1428 | 2972 | 2833 | 6761 | 2898 |
| 1429 | 2972 | 2834 | 7036 | 2899 |
| 1430 | 2973 | 2834 | 7038 | 2899 |
| 1431 | 2974 | 2835 | 7158 | 2900 |
| 1432 | 2974 | 2835 | 7160 | 2900 |
| 1433 | 2975 | 2836 | 2610 | 2901 |
| 1434 | 2976 | 2836 | 2610 | 2901 |
| 1435 | 2976 | 2837 | 2611 | 2902 |
| 1436 | 2977 | 2837 | 2611 | 2902 |
| 1437 | 2977 | 2838 | 2612 | 2903 |
| 1439 | 2978 | 2838 | 2612 | 2903 |
| 1440 | 2978 | 2839 | 2613 | 2904 |
| 1441 | 2979 | 2839 | 2613 | 2904 |
| 1442 | 2979 | 2840 | 2614 | 2905 |
| 1443 | 2980 | 2840 | 2614 | 2905 |
| 1444 | 2980 | 2841 | 2615 | 2906 |
| 1445 | 2981 | 2841 | 2615 | 2906 |
| 1446 | 2981 | 2842 | 2616 | 2907 |
| 1447 | 2982 | 2842 | 2616 | 2907 |
| 6001 | 2982 | 2843 | 2617 | 2908 |
| 6030 | 2983 | 2843 | 2617 | 2908 |
| 6078 | 2983 | 2844 | 2618 | 2909 |
| 6108 | 2984 | 2844 | 2618 | 2909 |
| 6130 | 2985 | 2845 | 2619 | 2910 |
| 6165 | 2985 | 2845 | 2619 | 2910 |

TABLE A5-continued

| Exemplary gene modifying polypeptides comprising an AVIRE RT domain or an MLVMS RT domain. | | | | |
|---|---|---|---|---|
| AVIRE SEQ ID NOs: | MLVMS SEQ ID NOs: | | | |
| 6265 | 2986 | 2846 | 2620 | 2911 |
| 6275 | 2987 | 2846 | 2620 | 2911 |
| 6305 | 2987 | 2847 | 2621 | 2912 |
| 6329 | 2988 | 2847 | 2621 | 2912 |
| 6370 | 2988 | 2848 | 2622 | 2913 |
| 6385 | 2989 | 2848 | 2622 | 2913 |
| 6404 | 2989 | 2849 | 2623 | 2914 |
| 6531 | 2990 | 2849 | 2623 | 2914 |
| 6585 | 2990 | 2850 | 2624 | 2915 |
| 6622 | 2991 | 2850 | 2624 | 2915 |
| 6652 | 2991 | 2851 | 2625 | 2916 |
| 6733 | 2992 | 2851 | 2625 | 2916 |
| 6756 | 2992 | 2852 | 2626 | 2917 |
| 6765 | 2993 | 2852 | 2626 | 2917 |
| 6798 | 2993 | 2853 | 2627 | 2918 |
| 6824 | 2994 | 2853 | 2627 | 2919 |
| 6972 | 2994 | 2854 | 2628 | 2919 |
| 7046 | 2995 | 2854 | 2628 | 2920 |
| 7054 | 2995 | 2855 | 2629 | 2920 |
| 7069 | 2996 | 2855 | 2629 | 2921 |
| 7080 | 2996 | 2856 | 2630 | 2921 |
| 7105 | 2997 | 2856 | 2630 | 2922 |
| 7123 | 2998 | 2857 | 2631 | 2922 |
| 7143 | 2998 | 2857 | 2631 | 2923 |
| 7152 | 2999 | 2858 | 2632 | 2923 |
| 7204 | 2999 | 2858 | 2632 | 2924 |
| 7320 | 3001 | 2859 | 2633 | 2924 |
| 7351 | 3001 | 2859 | 2633 | 2925 |
| 7381 | 3002 | 2860 | 2634 | 2925 |
| 7403 | 3002 | 2860 | 2634 | 2926 |
| 7438 | 3003 | 2861 | 2635 | 2926 |
| 7488 | 3003 | 2861 | 2635 | 2927 |
| 7500 | 3004 | 3035 | 2636 | 2927 |
| 7526 | 3004 | 3036 | 2636 | 2928 |
| 7588 | 3005 | 3036 | 2637 | 2928 |
| 7612 | 3005 | 3037 | 2637 | 2929 |
| 7627 | 3006 | 3037 | 2638 | 2929 |

Systems

In an aspect, the disclosure relates to a system comprising nucleic acid molecule encoding a gene modifying polypeptide (e.g., as described herein) and a template nucleic acid (e.g., a template RNA, e.g., as described herein). In certain embodiments, the nucleic acid molecule encoding the gene modifying polypeptide comprises one or more silent mutations in the coding region (e.g., in the sequence encoding the RT domain) relative to a nucleic acid molecule as described herein. In certain embodiments, the system further comprises a gRNA (e.g., a gRNA that binds to a polypeptide that induces a nick, e.g., in the opposite strand of the target DNA bound by the gene modifying polypeptide).

In certain embodiments, the nucleic acid molecule encoding the gene modifying polypeptide encodes a polypeptide having an amino acid sequence selected from SEQ ID NOs: 1-7743, or an amino acid sequence having at least 70%, 75%, 80%, 85%, 90%, 95%, or 99% identity thereto. In certain embodiments, the nucleic acid molecule encoding the gene modifying polypeptide encodes a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the nucleic acid molecule encoding the gene modifying polypeptide encodes a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the nucleic acid molecule encoding the gene modifying polypeptide encodes a polypeptide as listed in any of Tables A1, T1, or T2, or an amino acid sequence having at least 70%, 75%, 80%, 85%, 90%, 95%, or 99% identity thereto.

In certain embodiments, the nucleic acid molecule encoding the gene modifying polypeptide comprises a sequence encoding a portion of an amino acid sequence selected from SEQ ID NOs: 1-7743, wherein the portion comprises a linker and RT domain, or an amino acid sequence having at least 70%, 75%, 80%, 85%, 90%, 95%, or 99% identity to said portion. In certain embodiments, the nucleic acid molecule encoding the gene modifying polypeptide comprises a sequence encoding a portion of an amino acid sequence selected from SEQ ID NOs: 6001-7743, wherein the portion comprises a linker and RT domain, or an amino acid sequence having at least 70%, 75%, 80%, 85%, 90%, 95%, or 99% identity to said portion. In certain embodiments, the nucleic acid molecule encoding the gene modifying polypeptide comprises a sequence encoding a portion of an amino acid sequence selected from SEQ ID NOs: 4501-4541, wherein the portion comprises a linker and RT domain, or an amino acid sequence having at least 70%, 75%, 80%, 85%, 90%, 95%, or 99% identity to said portion. In certain embodiments, the nucleic acid molecule encoding the gene modifying polypeptide comprises a sequence encoding a portion of a polypeptide listed in any of Tables A1, T1, or T2, wherein the portion comprises a linker and RT domain, or an amino acid sequence having at least 70%, 75%, 80%, 85%, 90%, 95%, or 99% identity to said portion.

In certain embodiments, the nucleic acid molecule encoding the gene modifying polypeptide comprises a sequence encoding the linker of an amino acid sequence selected from SEQ ID NOs: 1-7743, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the linker of a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the linker of a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the linker of a polypeptide as listed in any of Tables A1, T1, or T2, or an amino acid sequence having at least 70%, 75%, 80%, 85%, 90%, 95%, or 99% identity thereto.

In certain embodiments, the nucleic acid molecule encoding the gene modifying polypeptide comprises a sequence encoding the RT domain of an amino acid sequence selected from SEQ ID NOs: 1-7743, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the RT domain of a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the RT domain of a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the RT domain of a polypeptide as listed in any of Tables A1, T1, or T2, or an amino acid sequence having at least 70%, 75%, 80%, 85%, 90%, 95%, or 99% identity thereto.

In an aspect, the disclosure relates to a system comprising a gene modifying polypeptide (e.g., as described herein) and a template nucleic acid (e.g., a template RNA, e.g., as described herein).

In certain embodiments, the gene modifying polypeptide comprises a polypeptide having an amino acid sequence selected from SEQ ID NOs: 1-7743, or an amino acid sequence having at least 70%, 75%, 80%, 85%, 90%, 95%, or 99% identity thereto. In certain embodiments, the gene modifying polypeptide comprises a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the gene modifying polypeptide comprises a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the gene modifying polypeptide comprises a polypeptide as listed in any of Tables A1, T1, or T2, or an amino acid sequence having at least 70%, 75%, 80%, 85%, 90%, 95%, or 99% identity thereto.

In certain embodiments, the gene modifying polypeptide comprises a portion of an amino acid sequence selected from SEQ ID NOs: 1-7743, wherein the portion comprises a linker and RT domain, or an amino acid sequence having at least 70%, 75%, 80%, 85%, 90%, 95%, or 99% identity to said portion. In certain embodiments, the gene modifying polypeptide comprises a portion of an amino acid sequence selected from SEQ ID NOs: 6001-7743, wherein the portion comprises a linker and RT domain, or an amino acid sequence having at least 70%, 75%, 80%, 85%, 90%, 95%, or 99% identity to said portion. In certain embodiments, the gene modifying polypeptide comprises a portion of an amino acid sequence selected from SEQ ID NOs: 4501-4541, wherein the portion comprises a linker and RT domain, or an amino acid sequence having at least 70%, 75%, 80%, 85%, 90%, 95%, or 99% identity to said portion. In certain embodiments, the gene modifying polypeptide comprises a portion of a polypeptide listed in any of Tables A1, T1, or T2, wherein the portion comprises a linker and RT domain, or an amino acid sequence having at least 70%, 75%, 80%, 85%, 90%, 95%, or 99% identity to said portion.

In certain embodiments, the gene modifying polypeptide comprises the linker of an amino acid sequence selected from SEQ ID NOs: 1-7743, or an amino acid sequence having at least 70%, 75%, 80%, 85%, 90%, 95%, or 99% identity thereto. In certain embodiments, the gene modifying polypeptide comprises a sequence encoding the linker of a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the gene modifying polypeptide comprises a sequence encoding the linker of a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the gene modifying polypeptide comprises the linker of a polypeptide as listed in any of Tables A1, T1, or T2, or an amino acid sequence having at least 70%, 75%, 80%, 85%, 90%, 95%, or 99% identity thereto.

In certain embodiments, the gene modifying polypeptide comprises the RT domain of an amino acid sequence selected from SEQ ID NOs: 1-7743, or an amino acid sequence having at least 70%, 75%, 80%, 85%, 90%, 95%, or 99% identity thereto. In certain embodiments, the gene modifying polypeptide comprises a sequence encoding the RT domain of a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the gene modifying polypeptide comprises a sequence encoding the RT domain of a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the gene modifying polypeptide comprises the RT domain of a polypeptide as listed in any of Tables A1, T1, or T2, or an amino acid sequence having at least 70%, 75%, 80%, 85%, 90%, 95%, or 99% identity thereto.

---

Lengthy table referenced here

US12544458-20260210-T00001

Please refer to the end of the specification for access instructions.

---

Localization Sequences for Gene Modifying Systems

In certain embodiments, a gene editor system RNA further comprises an intracellular localization sequence, e.g., a nuclear localization sequence (NLS). In some embodiments, a gene modifying polypeptide comprises an NLS as comprised in SEQ ID NO: 4000 and/or SEQ ID NO: 4001, or an NLS having an amino acid sequence having at least 75%, 80%, 85%, 90%, 95%, 96%, 97%, 98%, or 99% identity thereto.

The nuclear localization sequence may be an RNA sequence that promotes the import of the RNA into the nucleus. In certain embodiments the nuclear localization signal is located on the template RNA. In certain embodiments, the gene modifying polypeptide is encoded on a first RNA, and the template RNA is a second, separate, RNA, and the nuclear localization signal is located on the template RNA and not on an RNA encoding the gene modifying polypeptide. While not wishing to be bound by theory, in some embodiments, the RNA encoding the gene modifying polypeptide is targeted primarily to the cytoplasm to promote its translation, while the template RNA is targeted primarily to the nucleus to promote insertion into the genome. In some embodiments the nuclear localization signal is at the 3' end, 5' end, or in an internal region of the template RNA. In some embodiments the nuclear localization signal is 3' of the heterologous sequence (e.g., is directly 3' of the heterologous sequence) or is 5' of the heterologous sequence (e.g., is directly 5' of the heterologous sequence). In some embodiments the nuclear localization signal is placed outside of the 5' UTR or outside of the 3' UTR of the template RNA. In some embodiments the nuclear localization signal is placed between the 5' UTR and the 3' UTR, wherein optionally the nuclear localization signal is not transcribed with the transgene (e.g., the nuclear localization signal is an anti-sense orientation or is downstream of a transcriptional termination signal or polyadenylation signal). In some embodiments the nuclear localization sequence is situated inside of an intron. In some embodiments a plurality of the same or different nuclear localization signals are in the RNA, e.g., in the template RNA. In some embodiments the nuclear localization signal is less than 5, 10, 25, 50, 75, 100, 150, 200, 250, 300, 350, 400, 450, 500, 600, 700, 800, 900 or 1000 bp in length. Various RNA nuclear localization sequences can be used. For example, Lubelsky and Ulitsky, *Nature* 555 (107-111), 2018 describe RNA sequences which drive RNA localization into the nucleus. In some embodiments, the nuclear localization signal is a SINE-derived nuclear RNA localization (SIRLOIN) signal. In some embodiments the nuclear localization signal binds a nuclear-enriched protein. In some embodiments the nuclear localization signal binds the HNRNPK protein. In some embodiments the nuclear localization signal is rich in pyrimidines, e.g., is a C/T rich, C/U rich, C rich, T rich, or U rich region. In some embodiments the nuclear localization signal is derived from a long non-coding RNA. In some embodiments the nuclear localization signal is derived from MALAT1 long non-coding RNA or is the 600 nucleotide M region of MALAT1 (described in Miyagawa et al., *RNA* 18, (738-751), 2012). In some embodiments the nuclear localization signal is derived from BORG long non-coding RNA or is a AGCCC motif (described in Zhang et al., *Molecular and Cellular Biology* 34, 2318-2329 (2014). In some embodiments the nuclear localization sequence is described in Shukla et al., *The EMBO Journal* e98452 (2018). In some embodiments the nuclear localization signal is derived from a retrovirus.

In some embodiments, a polypeptide described herein comprises one or more (e.g., 2, 3, 4, 5) nuclear targeting sequences, for example a nuclear localization sequence (NLS). In some embodiments, the NLS is a bipartite NLS. In some embodiments, an NLS facilitates the import of a protein comprising an NLS into the cell nucleus. In some embodiments, the NLS is fused to the N-terminus of a gene modifying polypeptide as described herein. In some embodiments, the NLS is fused to the C-terminus of the gene modifying polypeptide. In some embodiments, the NLS is fused to the N-terminus or the C-terminus of a Cas domain. In some embodiments, a linker sequence is disposed between the NLS and the neighboring domain of the gene modifying polypeptide.

In some embodiments, an NLS comprises the amino acid sequence MDSLLMNRRKFLYQFKNVRWAKGRRETYLC (SEQ ID NO: 5009), PKKRKVEGADKRTADGSEFESPKKKRKV (SEQ ID NO: 5010), RKSGKIAAIWKRPRKPKKKRKV (SEQ ID NO: 5011) KRTADGSEFESPKKKRKV (SEQ ID NO: 5012), KKTELQTTNAENKTKKL (SEQ ID NO: 5013), or KRGINDRNFWRGENGRKTR (SEQ ID NO: 5014), KRPAATKKAGQAKKKK (SEQ ID NO: 5015), PAAKRVKLD (SEQ ID NO: 4644), KRTADGSEFEKRTADGSEFESPKKKAKVE (SEQ ID NO: 4649), KRTADGSEFE (SEQ ID NO: 4650), KRTADGSEFESPKKKAKVE (SEQ ID NO: 11098), AGKRTADGSEFEKRTADGSEFESPKKKAKVE (SEQ ID NO: 4651), or a functional fragment or variant thereof. Exemplary NLS sequences are also described in PCT/EP2000/011690, the contents of which are incorporated herein by reference for their disclosure of exemplary nuclear localization sequences. In some embodiments, an NLS comprises an amino acid sequence as disclosed in Table 11. An NLS of this table may be utilized with one or more copies in a polypeptide in one or more locations in a polypeptide, e.g., 1, 2, 3 or more copies of an NLS in an N-terminal domain, between peptide domains, in a C-terminal domain, or in a combination of locations, in order to improve subcellular localization to the nucleus. Multiple unique sequences may be used within a single polypeptide. Sequences may be naturally monopartite or bipartite, e.g., having one or two stretches of basic amino acids, or may be used as chimeric bipartite sequences. Sequence references correspond to UniProt accession numbers, except where indicated as SeqNLS for sequences mined using a subcellular localization prediction algorithm (Lin et al BMC Bioinformat 13:157 (2012), incorporated herein by reference in its entirety).

TABLE 11

Exemplary nuclear localization signals for use in gene modifying systems

| Sequence | Sequence References | SEQ ID No. |
|---|---|---|
| AHFKISGEKRPSTDPGKKAKNPKKKKKKDP | Q76IQ7 | 5223 |

TABLE 11-continued

| Exemplary nuclear localization signals for use in gene modifying systems | | |
|---|---|---|
| Sequence | Sequence References | SEQ ID No. |
| AHRAKKMSKTHA | P21827 | 5224 |
| ASPEYVNLPINGNG | SeqNLS | 5225 |
| CTKRPRW | O88622, Q86W56, Q9QYM2, O02776 | 5226 |
| DKAKRVSRNKSEKKRR | O15516, Q5RAK8, Q91YB2, Q91YB0, Q8QGQ6, O08785, Q9WVS9, Q6YGZ4 | 5227 |
| EELRLKEELLKGIYA | Q9QY16, Q9UHL0, Q2TBP1, Q9QY15 | 5228 |
| EEQLRRRKNSRLNNTG | G5EFF5 | 5229 |
| EVLKVIRTGKRKKKAWKR MVTKVC | SeqNLS | 5230 |
| HHHHHHHHHHHQPH | Q63934, G3V7L5, Q12837 | 5231 |
| HKKKHPDASVNFSEFSK | P10103, Q4R844, P12682, B0CM99, A9RA84, Q6YKA4, P09429, P63159, Q08IE6, P63158, Q9YH06, B1MTB0 | 5232 |
| HKRTKK | Q2R2D5 | 5233 |
| IINGRKLKLKKSRRRSSQTS NNSFTSRRS | SeqNLS | 5234 |
| KAEQERRK | Q8LH59 | 5235 |
| KEKRKRREELFIEQKKRK | SeqNLS | 5236 |
| KKGKDEWFSRGKKP | P30999 | 5237 |
| KKGPSVQKRKKT | Q6ZN17 | 5238 |
| KKKTVINDLLHYKKEK | SeqNLS, P32354 | 5239 |
| KKNGGKGKNKPSAKIKK | SeqNLS | 5240 |
| KKPKWDDFKKKKK | Q15397, Q8BKS9, Q562C7 | 5241 |
| KKRKKD | SeqNLS, Q91Z62, Q1A730, Q969P5, Q2KHT6, Q9CPU7 | 5242 |
| KKRRKRRRK | SeqNLS | 5243 |
| KKRRRRARK | Q9UMS6, D4A702, Q91YE8 | 5244 |
| KKSKRGR | Q9UBS0 | 5245 |
| KKSRKRGS | B4FG96 | 5246 |
| KKSTALSRELGKIMRRR | SeqNLS, P32354 | 5247 |
| KKSYQDPEIIAHSRPRK | Q9U7C9 | 5248 |
| KKTGKNRKLKSKRVKTR | Q9Z301, O54943, Q8K3T2 | 5249 |
| KKVSIAGQSGKLWRWKR | Q6YUL8 | 5250 |
| KKYENVVIKRSPRKRGRPR K | SeqNLS | 5251 |
| KNKKRK | SeqNLS | 5252 |
| KPKKKR | SeqNLS | 5253 |
| KRAMKDDSHGNSTSPKRRK | Q0E671 | 5254 |
| KRANSNLVAAYEKAKKK | P23508 | 5255 |
| KRASEDTTSGSPPKKSSAGP KR | Q9BZZ5, Q5R644 | 5256 |

TABLE 11-continued

Exemplary nuclear localization signals for use in gene modifying systems

| Sequence | Sequence References | SEQ ID No. |
|---|---|---|
| KRFKRRWMVRKMKTKK | SeqNLS | 5257 |
| KRGLNSSFETSPKKVK | Q8IV63 | 5258 |
| KRGNSSIGPNDLSKRKQRKK | SeqNLS | 5259 |
| KRIHSVSLSQSQIDPSKKVKRAK | SeqNLS | 5260 |
| KRKGKLKNKGSKRKK | O15381 | 5261 |
| KRRRRRRREKRKR | Q96GM8 | 5262 |
| KRSNDRTYSPEEEKORRA | Q91ZF2 | 5263 |
| KRTVATNGDASGAHRAKKMSK | SeqNLS | 5264 |
| KRVYNKGEDEQEHLPKGKKR | SeqNLS | 5265 |
| KSGKAPRRRAVSMDNSNK | Q9WVH4, O43524 | 5266 |
| KVNFLDMSLDDIIIYKELE | Q9P127 | 5267 |
| KVQHRIAKKTTRRRR | Q9DXE6 | 5268 |
| LSPSLSPL | Q9Y261, P32182, P35583 | 5269 |
| MDSLLMNRRKFLYQFKNVRWAKGRRETYLC | Q9GZX7 | 5270 |
| MPQNEYIELHRKRYGYRLDYHEKKRKKESREAHERSKKAKKMIGLKAKLYHK | SeqNLS | 5271 |
| MVQLRPRASR | SeqNLS | 5272 |
| NNKLLAKRRKGGASPKDDPMDDIK | Q965G5 | 5273 |
| NYKRPMDGTYGPPAKRHEGE | O14497, A2BH40 | 5274 |
| PDTKRAKLDSSETTMVKKK | SeqNLS | 5275 |
| PEKRTKI | SeqNLS | 5276 |
| PGGRGKKK | Q719N1, Q9UBP0, A2VDN5 | 5277 |
| PGKMDKGEHRQERRDRPY | Q01844, Q61545 | 5278 |
| PKKGDKYDKTD | Q45FA5 | 5279 |
| PKKKSRK | O35914, Q01954 | 5280 |
| PKKNKPE | Q22663 | 5281 |
| PKKRAKV | P04295, P89438 | 5282 |
| PKPKKLKVE | P55263, P55262, P55264, Q64640 | 5283 |
| PKRGRGR | Q9FYS5, Q43386 | 5284 |
| PKRRLVDDA | P0C797 | 5285 |
| PKRRRTY | SeqNLS | 5286 |
| PLFKRR | A8X6H4, Q9TXJ0 | 5287 |
| PLRKAKR | Q86WB0, Q5R8V9 | 5288 |

TABLE 11-continued

Exemplary nuclear localization signals for use in gene modifying systems

| Sequence | Sequence References | SEQ ID No. |
|---|---|---|
| PPAKRKCIF | Q6AZ28, O75928, Q8C5D8 | 5289 |
| PPARRRRL | Q8NAG6 | 5290 |
| PPKKKRKV | Q3L6L5, P03070, P14999, P03071 | 5291 |
| PPNKRMKVKH | Q8BN78 | 5292 |
| PPRIYPQLPSAPT | P0C799 | 5293 |
| PQRSPFPKSSVKR | SeqNLS | 5294 |
| PRPRKVPR | P0C799 | 5295 |
| PRRRVQRKR | SeqNLS, Q5R448, Q5TAQ9 | 5296 |
| PRRVRLK | Q58DJ0, P56477, Q13568 | 5297 |
| PSRKRPR | Q62315, Q5F363, Q92833 | 5298 |
| PSSKKRKV | SeqNLS | 5299 |
| PTKKRVK | P07664 | 5300 |
| QRPGPYDRP | SeqNLS | 5301 |
| RGKGGKGLGKGGAKRHRK | SeqNLS | 5302 |
| RKAGKGGGGHKTTKKRSA KDEKVP | B4FG96 | 5303 |
| RKIKLKRAK | A1L3G9 | 5304 |
| RKIKRKRAK | B9X187 | 5305 |
| RKKEAPGPREELRSRGR | O35126, P54258, Q5IS70, P54259 | 5306 |
| RKKRKGK | SeqNLS, Q29243, Q62165, Q28685, O18738, Q9TSZ6, Q14118 | 5307 |
| RKKRRQRRR | P04326, P69697, P69698, P05907, P20879, P04613, P19553, P0C1J9, P20893, P12506, P04612, Q73370, P0C1K0, P05906, P35965, P04609, P04610, P04614, P04608, P05905 | 5308 |
| RKKSIPLSIKNLKRKHKRKK NKITR | Q9C0C9 | 5309 |
| RKLVKPKNTKMKTKLRTNP Y | Q14190 | 5310 |
| RKRLILSDKGQLDWKK | SeqNLS, Q91Z62, Q1A730, Q2KHT6, Q9CPU7 | 5311 |
| RKRLKSK | Q13309 | 5312 |
| RKRRVRDNM | Q8QPH4, Q809M7, A8C8X1, Q2VNC5, Q38SQ0, O89749, Q6DNQ9, Q809L9, Q0A429, Q20NV3, P16509, P16505, Q6DNQ5, P16506, Q6XT06, P26118, Q2ICQ2, Q2RCG8, Q0A2D0, Q0A2H9, Q9IQ46, Q809M3, Q6J847, Q6J856, B4URE4, A4GCM7, Q0A440, P26120, P16511, | 5313 |
| RKRSPKDKKEKDLDGAGKR RKT | Q7RTP6 | 5314 |
| RKRTPRVDGQTGENDMNK RRRK | O94851 | 5315 |
| RLPVRRRRRR | P04499, P12541, P03269, P48313, P03270 | 5316 |

TABLE 11-continued

| Exemplary nuclear localization signals for use in gene modifying systems | | |
|---|---|---|
| Sequence | Sequence References | SEQ ID No. |
| RLRFRKPKSK | P69469 | 5317 |
| RQQRKR | Q14980 | 5318 |
| RRDLNSSFETSPKKVK | Q8K3G5 | 5319 |
| RRDRAKLR | Q9SLB8 | 5320 |
| RRGDGRRR | Q80WE1, Q5R9B4, Q06787, P35922 | 5321 |
| RRGRKRKAEKQ | Q812D1, Q5XXA9, Q99JF8, Q8MJG1, Q66T72, O75475 | 5322 |
| RRKKRR | Q0VD86, Q58DS6, Q5R6G2, Q9ERI5, Q6AYK2, Q6NYC1 | 5323 |
| RRKRSKSEDMDSVESKRRR | Q7TT18 | 5324 |
| RRKRSR | Q99PU7, D3ZHS6, Q92560, A2VDM8 | 5325 |
| RRPKGKTLQKRKPK | Q6ZN17 | 5326 |
| RRRGFERFGPDNMGRKRK | Q63014, Q9DBR0 | 5327 |
| RRRGKNKVAAQNCRK | SeqNLS | 5328 |
| RRRKRR | Q5FVH8, Q6MZT1, Q08DH5, Q8BQP9 | 5329 |
| RRRQKQKGGASRRR | SeqNLS | 5330 |
| RRRREGPRARRRR | P08313, P10231 | 5331 |
| RRTIRLKLVYDKCDRSCKIQ KKNRNKCQYCRFHKCLSVG MSHNAIRFGRMPRSEKAKL KAE | SeqNLS | 5332 |
| RRVPQRKEVSRCRKCRK | Q5RJN4, Q32L09, Q8CAK3, Q9NUL5 | 5333 |
| RVGGRRQAVECIEDLLNEP GQPLDLSCKRPRP | P03255 | 5334 |
| RVVKLRIAP | P52639, Q8JMN0 | 5335 |
| RVVRRR | P70278 | 5336 |
| SKRKTKISRKTR | Q5RAY1, O00443 | 5337 |
| SYVKTVPNRTRTYIKL | P21935 | 5338 |
| TGKNEAKKRKIA | P52739, Q8K3J5, Q5RAU9 | 5339 |
| TLSPASSPSSVSCPVIPASTD ESPGSALNI | SeqNLS | 5340 |
| VSKKQRTGKKIH | P52739, Q8K3J5, Q5RAU9 | 5341 |
| SPKKKRKVE | | 5342 |
| KRTAD GSEFE SPKKKRKVE | | 5343 |
| PAAKRVKLD | | 5344 |
| PKKKRKV | | 5345 |
| MDSLLMNRRKFLYQFKNVR WAKGRRETYLC | | 5346 |
| SPKKKRKVEAS | | 5347 |
| MAPKKKRKVGIHRGVP | | 5348 |
| KRTADGSEFEKRTADGSEFE | | 5349 |

TABLE 11-continued

| Exemplary nuclear localization signals for use in gene modifying systems | | |
|---|---|---|
| Sequence | Sequence References | SEQ ID No. |
| SPKKKAKVE | | |
| KRTADGSEFE | | 5350 |
| KRTADGSEFESPKKKAKVE | | 5351 |
| AGKRTADGSEFEKRTADGS EFESPKKKAKVE | | 4001 |

In some embodiments, the NLS is a bipartite NLS. A bipartite NLS typically comprises two basic amino acid clusters separated by a spacer sequence (which may be, e.g., about 10 amino acids in length). A monopartite NLS typically lacks a spacer. An example of a bipartite NLS is the nucleoplasmin NLS, having the sequence KR[PAATKKAGQA]KKKK (SEQ ID NO: 5015), wherein the spacer is bracketed. Another exemplary bipartite NLS has the sequence PKKKRKVEGADKRTADGSEFESPKKKRKV (SEQ ID NO: 5016). Exemplary NLSs are described in International Application WO2020051561, which is herein incorporated by reference in its entirety, including for its disclosures regarding nuclear localization sequences.

In certain embodiments, a gene editor system polypeptide (e.g., a gene modifying polypeptide as described herein) further comprises an intracellular localization sequence, e.g., a nuclear localization sequence and/or a nucleolar localization sequence. The nuclear localization sequence and/or nucleolar localization sequence may be amino acid sequences that promote the import of the protein into the nucleus and/or nucleolus, where it can promote integration of heterologous sequence into the genome. In certain embodiments, a gene editor system polypeptide (e.g., (e.g., a gene modifying polypeptide as described herein) further comprises a nucleolar localization sequence. In certain embodiments, the gene modifying polypeptide is encoded on a first RNA, and the template RNA is a second, separate, RNA, and the nucleolar localization signal is encoded on the RNA encoding the gene modifying polypeptide and not on the template RNA. In some embodiments, the nucleolar localization signal is located at the N-terminus, C-terminus, or in an internal region of the polypeptide. In some embodiments, a plurality of the same or different nucleolar localization signals are used. In some embodiments, the nuclear localization signal is less than 5, 10, 25, 50, 75, or 100 amino acids in length. Various polypeptide nucleolar localization signals can be used. For example, Yang et al., *Journal of Biomedical Science* 22, 33 (2015), describe a nuclear localization signal that also functions as a nucleolar localization signal. In some embodiments, the nucleolar localization signal may also be a nuclear localization signal. In some embodiments, the nucleolar localization signal may overlap with a nuclear localization signal. In some embodiments, the nucleolar localization signal may comprise a stretch of basic residues. In some embodiments, the nucleolar localization signal may be rich in arginine and lysine residues. In some embodiments, the nucleolar localization signal may be derived from a protein that is enriched in the nucleolus. In some embodiments, the nucleolar localization signal may be derived from a protein enriched at ribosomal RNA loci. In some embodiments, the nucleolar localization signal may be derived from a protein that binds rRNA. In some embodiments, the nucleolar localization signal may be derived from MSP58. In some embodiments, the nucleolar localization signal may be a monopartite motif. In some embodiments, the nucleolar localization signal may be a bipartite motif. In some embodiments, the nucleolar localization signal may consist of a multiple monopartite or bipartite motifs. In some embodiments, the nucleolar localization signal may consist of a mix of monopartite and bipartite motifs. In some embodiments, the nucleolar localization signal may be a dual bipartite motif. In some embodiments, the nucleolar localization motif may be a KRASSQALGTIPKRRSSSRFIKRKK (SEQ ID NO: 5017). In some embodiments, the nucleolar localization signal may be derived from nuclear factor-κB-inducing kinase. In some embodiments, the nucleolar localization signal may be an RKKRKKK motif (SEQ ID NO: 5018) (described in Birbach et al., Journal of Cell Science, 117 (3615-3624), 2004).

Evolved Variants of Gene Modifying Polypeptides and Systems

In some embodiments, the invention provides evolved variants of gene modifying polypeptides as described herein. Evolved variants can, in some embodiments, be produced by mutagenizing a reference gene modifying polypeptide, or one of the fragments or domains comprised therein. In some embodiments, one or more of the domains (e.g., the reverse transcriptase domain) is evolved. One or more of such evolved variant domains can, in some embodiments, be evolved alone or together with other domains. An evolved variant domain or domains may, in some embodiments, be combined with unevolved cognate component(s) or evolved variants of the cognate component(s), e.g., which may have been evolved in either a parallel or serial manner.

In some embodiments, the process of mutagenizing a reference gene modifying polypeptide, or fragment or domain thereof, comprises mutagenizing the reference gene modifying polypeptide or fragment or domain thereof. In embodiments, the mutagenesis comprises a continuous evolution method (e.g., PACE) or non-continuous evolution method (e.g., PANCE), e.g., as described herein. In some embodiments, the evolved gene modifying polypeptide, or a fragment or domain thereof, comprises one or more amino acid variations introduced into its amino acid sequence relative to the amino acid sequence of the reference gene modifying polypeptide, or fragment or domain thereof. In embodiments, amino acid sequence variations may include one or more mutated residues (e.g., conservative substitutions, non-conservative substitutions, or a combination thereof) within the amino acid sequence of a reference gene modifying polypeptide, e.g., as a result of a change in the nucleotide sequence encoding the gene modifying polypeptide that results in, e.g., a change in the codon at any particular position in the coding sequence, the deletion of one or more amino acids (e.g., a truncated protein), the insertion of one or more amino acids, or any combination of the foregoing. The evolved variant gene modifying polypeptide may include variants in one or more components or domains of the gene modifying polypeptide (e.g., variants introduced into a reverse transcriptase domain).

In some aspects, the disclosure provides gene modifying polypeptides, systems, kits, and methods using or comprising an evolved variant of a gene modifying polypeptide, e.g., employs an evolved variant of a gene modifying polypeptide or a gene modifying polypeptide produced or producible by PACE or PANCE. In embodiments, the unevolved reference gene modifying polypeptide is a gene modifying polypeptide as disclosed herein.

The term "phage-assisted continuous evolution (PACE)," as used herein, generally refers to continuous evolution that employs phage as viral vectors. Examples of PACE technology have been described, for example, in International PCT Application No. PCT/US 2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015; U.S. Pat. No. 9,771,574, issued Sep. 26, 2017; U.S. Pat. No. 9,394, 537, issued Jul. 19, 2016; International PCT Application, PCT/US2015/012022, filed Jan. 20, 2015, published as WO 2015/134121 on Sep. 11, 2015; U.S. Pat. No. 10,179,911, issued Jan. 15, 2019; and International PCT Application, PCT/US2016/027795, filed Apr. 15, 2016, published as WO 2016/168631 on Oct. 20, 2016, the entire contents of each of which are incorporated herein by reference.

The term "phage-assisted non-continuous evolution (PANCE)," as used herein, generally refers to non-continuous evolution that employs phage as viral vectors. Examples of PANCE technology have been described, for example, in Suzuki T. et al, Crystal structures reveal an elusive functional domain of pyrrolysyl-tRNA synthetase, Nat Chem Biol. 13(12): 1261-1266 (2017), incorporated herein by reference in its entirety. Briefly, PANCE is a technique for rapid in vivo directed evolution using serial flask transfers of evolving selection phage (SP), which contain a gene of interest to be evolved, across fresh host cells (e.g., *E. coli* cells). Genes inside the host cell may be held constant while genes contained in the SP continuously evolve. Following phage growth, an aliquot of infected cells may be used to transfect a subsequent flask containing host *E. coli*. This process can be repeated and/or continued until the desired phenotype is evolved, e.g., for as many transfers as desired.

Methods of applying PACE and PANCE to gene modifying polypeptides may be readily appreciated by the skilled artisan by reference to, inter alia, the foregoing references. Additional exemplary methods for directing continuous evolution of genome-modifying proteins or systems, e.g., in a population of host cells, e.g., using phage particles, can be applied to generate evolved variants of gene modifying polypeptides, or fragments or subdomains thereof. Non-limiting examples of such methods are described in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015; U.S. Pat. No. 9,771,574, issued Sep. 26, 2017; U.S. Pat. No. 9,394, 537, issued Jul. 19, 2016; International PCT Application, PCT/US2015/012022, filed Jan. 20, 2015, published as WO 2015/134121 on Sep. 11, 2015; U.S. Pat. No. 10,179,911, issued Jan. 15, 2019; International Application No. PCT/US2019/37216, filed Jun. 14, 2019, International Patent Publication WO 2019/023680, published Jan. 31, 2019, International PCT Application, PCT/US2016/027795, filed Apr. 15, 2016, published as WO 2016/168631 on Oct. 20, 2016, and International Patent Publication No. PCT/US2019/47996, filed Aug. 23, 2019, each of which is incorporated herein by reference in its entirety.

In some non-limiting illustrative embodiments, a method of evolution of a evolved variant gene modifying polypeptide, of a fragment or domain thereof, comprises: (a) contacting a population of host cells with a population of viral vectors comprising the gene of interest (the starting gene modifying polypeptide or fragment or domain thereof), wherein: (1) the host cell is amenable to infection by the viral vector; (2) the host cell expresses viral genes required for the generation of viral particles; (3) the expression of at least one viral gene required for the production of an infectious viral particle is dependent on a function of the gene of interest; and/or (4) the viral vector allows for expression of the protein in the host cell, and can be replicated and packaged into a viral particle by the host cell. In some embodiments, the method comprises (b) contacting the host cells with a mutagen, using host cells with mutations that elevate mutation rate (e.g., either by carrying a mutation plasmid or some genome modification—e.g., proofing-impaired DNA polymerase, SOS genes, such as UmuC, UmuD', and/or RecA, which mutations, if plasmid-bound, may be under control of an inducible promoter), or a combination thereof. In some embodiments, the method comprises (c) incubating the population of host cells under conditions allowing for viral replication and the production of viral particles, wherein host cells are removed from the host cell population, and fresh, uninfected host cells are introduced into the population of host cells, thus replenishing the population of host cells and creating a flow of host cells. In some embodiments, the cells are incubated under conditions allowing for the gene of interest to acquire a mutation. In some embodiments, the method further comprises (d) isolating a mutated version of the viral vector, encoding an evolved gene product (e.g., an evolved variant gene modifying polypeptide, or fragment or domain thereof), from the population of host cells.

The skilled artisan will appreciate a variety of features employable within the above-described framework. For example, in some embodiments, the viral vector or the phage is a filamentous phage, for example, an M13 phage, e.g., an M13 selection phage. In certain embodiments, the gene required for the production of infectious viral particles is the M13 gene III (gIII) In embodiments, the phage may lack a functional gIII, but otherwise comprise gI, gII, gIV, gV, gVI, gVII, gVIII, gIX, and a gX. In some embodiments, the generation of infectious VSV particles involves the envelope protein VSV-G. Various embodiments can use different retroviral vectors, for example, Murine Leukemia Virus vectors, or Lentiviral vectors. In embodiments, the retroviral vectors can efficiently be packaged with VSV-G envelope protein, e.g., as a substitute for the native envelope protein of the virus.

In some embodiments, host cells are incubated according to a suitable number of viral life cycles, e.g., at least 10, at least 20, at least 30, at least 40, at least 50, at least 100, at least 200, at least 300, at least 400, at least, 500, at least 600, at least 700, at least 800, at least 900, at least 1000, at least 1250, at least 1500, at least 1750, at least 2000, at least 2500, at least 3000, at least 4000, at least 5000, at least 7500, at least 10000, or more consecutive viral life cycles, which in on illustrative and non-limiting examples of M13 phage is 10-20 minutes per virus life cycle. Similarly, conditions can be modulated to adjust the time a host cell remains in a population of host cells, e.g., about 10, about 11, about 12, about 13, about 14, about 15, about 16, about 17, about 18, about 19, about 20, about 21, about 22, about 23, about 24, about 25, about 30, about 35, about 40, about 45, about 50, about 55, about 60, about 70, about 80, about 90, about 100, about 120, about 150, or about 180 minutes. Host cell populations can be controlled in part by density of the host cells, or, in some embodiments, the host cell density in an inflow, e.g., $10^3$ cells/ml, about $10^4$ cells/ml, about $10^5$ cells/ml, about $5\text{-}10^5$ cells/ml, about $10^6$ cells/ml, about $5\text{-}10^6$ cells/ml, about $10^7$ cells/ml, about $5\text{-}10^7$ cells/ml, about $10^8$ cells/ml, about $5\text{-}10^8$ cells/ml, about $10^9$ cells/ml, about $5\cdot10^9$ cells/ml, about $10^{10}$ cells/ml, or about $5\cdot10^{10}$ cells/ml.

Inteins

In some embodiments, as described in more detail below, an intein-N (intN) domain may be fused to the N-terminal portion of a first domain of a gene modifying polypeptide described herein, and an intein-C (intC) domain may be fused to the C-terminal portion of a second domain of a gene modifying polypeptide described herein for the joining of the N-terminal portion to the C-terminal portion, thereby joining the first and second domains. In some embodiments, the first and second domains are each independently chosen from a DNA binding domain, an RNA binding domain, an RT domain, and an endonuclease domain.

Inteins can occur as self-splicing protein intron (e.g., peptide), e.g., which ligates flanking N-terminal and C-terminal exteins (e.g., fragments to be joined). An intein may, in some instances, comprise a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing."

In some embodiments, an intein of a precursor protein (an intein containing protein prior to intein-mediated protein splicing) comes from two genes. Such intein is referred to herein as a split intein (e.g., split intein-N and split intein-C). Accordingly, an intein-based approach may be used to join a first polypeptide sequence and a second polypeptide sequence together. For example, in cyanobacteria, DnaE, the catalytic subunit a of DNA polymerase III, is encoded by two separate genes, dnaE-n and dnaE-c. An intein-N domain, such as that encoded by the dnaE-n gene, when situated as part of a first polypeptide sequence, may join the first polypeptide sequence with a second polypeptide sequence, wherein the second polypeptide sequence comprises an intein-C domain, such as that encoded by the dnaE-c gene. Accordingly, in some embodiments, a protein can be made by providing nucleic acid encoding the first and second polypeptide sequences (e.g., wherein a first nucleic acid molecule encodes the first polypeptide sequence and a second nucleic acid molecule encodes the second polypeptide sequence), and the nucleic acid is introduced into the cell under conditions that allow for production of the first and second polypeptide sequences, and for joining of the first to the second polypeptide sequence via an intein-based mechanism.

Use of inteins for joining heterologous protein fragments is described, for example, in Wood et al., J. Biol. Chem.289 (21); 14512-9 (2014) (incorporated herein by reference in its entirety). For example, when fused to separate protein fragments, the inteins IntN and IntC may recognize each other, splice themselves out, and/or simultaneously ligate the flanking N- and C-terminal exteins of the protein fragments to which they were fused, thereby reconstituting a full-length protein from the two protein fragments.

In some embodiments, a synthetic intein based on the dnaE intein, the Cfa-N (e.g., split intein-N) and Cfa-C (e.g., split intein-C) intein pair, is used. Examples of such inteins have been described, e.g., in Stevens et al., J Am Chem Soc. 2016 Feb. 24; 138(7):2162-5 (incorporated herein by reference in its entirety). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394, 604, incorporated herein by reference.

In some embodiments involving a split Cas9, an intein-N domain and an intein-C domain may be fused to the N-terminal portion of the split Cas9 and the C-terminal portion of a split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N—[N-terminal portion of the split Cas9]-[intein-N]~C. In some embodiments, an intein-C is fused to the N-terminus of the C-terminal portion of the split Cas9, i.e., to form a structure of N-[intein-C]~[C-terminal portion of the split Cas9]-C. The mechanism of intein-mediated protein splicing for joining the proteins the inteins are fused to (e.g., split Cas9) is described in Shah et al., Chem Sci. 2014; 5(1):446-461, incorporated herein by reference. Methods for designing and using inteins are known in the art and described, for example by WO2020051561, WO2014004336, WO2017132580, US20150344549, and US20180127780, each of which is incorporated herein by reference in their entirety.

In some embodiments, a split refers to a division into two or more fragments. In some embodiments, a split Cas9 protein or split Cas9 comprises a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a reconstituted Cas9 protein. In embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351: 867-871 and PDB file: 5F9R (each of which is incorporated herein by reference in its entirety). A disordered region may be determined by one or more protein structure determination techniques known in the art, including, without limitation, X-ray crystallography, NMR spectroscopy, electron microscopy (e.g., cryoEM), and/or in silico protein modeling. In some embodiments, the protein is divided into two fragments at any C, T, A, or S, e.g., within a region of SpCas9 between amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9 T310, T313, A456, S469, or C574. In some embodiments, the process of dividing the protein into two fragments is referred to as splitting the protein.

In some embodiments, a protein fragment ranges from about 2-1000 amino acids (e.g., between 2-10, 10-50, 50-100, 100-200, 200-300, 300-400, 400-500, 500-600, 600-700, 700-800, 800-900, or 900-1000 amino acids) in length. In some embodiments, a protein fragment ranges from about 5-500 amino acids (e.g., between 5-10, 10-50, 50-100, 100-200, 200-300, 300-400, or 400-500 amino acids) in length. In some embodiments, a protein fragment ranges from about 20-200 amino acids (e.g., between 20-30, 30-40, 40-50, 50-100, or 100-200 amino acids) in length.

In some embodiments, a portion or fragment of a gene modifying polypeptide is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

In some embodiments, an endonuclease domain (e.g., a nickase Cas9 domain) is fused to intein-N and a polypeptide comprising an RT domain is fused to an intein-C.

Exemplary nucleotide and amino acid sequences of intein-N domains and compatible intein-C domains are provided below:

```
DnaE Intein-N DNA:
                                          (SEQ ID NO: 5029)
TGCCTGTCATACGAAACCGAGATACTGACAGTAGAATATGGCCTTCTG

CCAATCGGGAAGATTGTGGAGAAACGGATAGAATGCACAGTTTACTCT

GTCGATAACAATGGTAACATTTATACTCAGCCAGTTGCCCAGTGGCAC

GACCGGGGAGAGCAGGAAGTATTCGAATACTGTCTGGAGGATGGAAGT

CTCATTAGGGCCACTAAGGACCACAAATTTATGACAGTCGATGGCCAG

ATGCTGCCTATAGACGAAATCTTTGAGCGAGAGTTGGACCTCATGCGA

GTTGACAACCTTCCTAAT

DnaE Intein-N Protein:
                                          (SEQ ID NO: 5030)
CLSYETEILTVEYGLLPIGKIVEKRIECTVYSVDNNGNIYTQPVAQWH

DRGEQEVFEYCLEDGSLIRATKDHKFMTVDGQMLPIDEIFERELDLMR

VDNLPN

DnaE Intein-C DNA:
                                          (SEQ ID NO: 5031)
ATGATCAAGATAGCTACAAGGAAGTATCTTGGCAAACAAAACGTTTAT

GATATTGGAGTCGAAAGAGATCACAACTTTGCTCTGAAGAACGGATTC

ATAGCTTCTAAT

DnaE Intein-C Protein:
                                          (SEQ ID NO: 5032)
MIKIATRKYLGKQNVYDIGVERDHNFALKNGFIASN

Cfa-N DNA:
                                          (SEQ ID NO: 5033)
TGCCTGTCTTATGATACCGAGATACTTACCGTTGAATATGGCTTCTTG

CCTATTGGAAAGATTGTCGAAGAGAGAATTGAATGCACAGTATATACT

GTAGACAAGAATGGTTTCGTTTACACACAGCCCATTGCTCAATGGCAC

AATCGCGGCGAACAAGAAGTATTTGAGTACTGTCTCGAGGATGGAAGC

ATCATACGAGCAACTAAAGATCATAAATTCATGACCACTGACGGGCAG
```

-continued

```
ATGTTGCCAATAGATGAGATATTCGAGCGGGGCTTGGATCTCAAACAA

GTGGATGGATTG CCA

Cfa-N Protein:
                                          (SEQ ID NO: 5034)
CLSYDTEILTVEYGFLPIGKIVEERIECTVYTVDKNGFVYTQPIAQWH

NRGEQEVFEYCLEDGSIIRATKDHKFMTTDGQMLPIDEIFERGLDLKQ

VDGLP

Cfa-C DNA:
                                          (SEQ ID NO: 5035)
ATGAAGAGGACTGCCGATGGATCAGAGTTTGAATCTCCCAAGAAGAAG

AGGAAAGTAAAGATAATATCTCGAAAAAGTCTTGGTACCCAAAATGTC

TATGATATTGGAGTGGAGAAAGATCACAACTTCCTTCTCAAGAACGGT

CTCGTAGCCAGCAAC

Cfa-C Protein:
                                          (SEQ ID NO: 5036)
MKRTADGSEFESPKKKRKVKIISRKSLGTQNVYDIGVEKDHNFLLKNG

LVASN
```

Additional Domains

The gene modifying polypeptide can bind a target DNA sequence and template nucleic acid (e.g., template RNA), nick the target site, and write (e.g., reverse transcribe) the template into DNA, resulting in a modification of the target site. In some embodiments, additional domains may be added to the polypeptide to enhance the efficiency of the process. In some embodiments, the gene modifying polypeptide may contain an additional DNA ligation domain to join reverse transcribed DNA to the DNA of the target site. In some embodiments, the polypeptide may comprise a heterologous RNA-binding domain. In some embodiments, the polypeptide may comprise a domain having 5' to 3' exonuclease activity (e.g., wherein the 5' to 3' exonuclease activity increases repair of the alteration of the target site, e.g., in favor of alteration over the original genomic sequence). In some embodiments, the polypeptide may comprise a domain having 3' to 5' exonuclease activity, e.g., proof-reading activity. In some embodiments, the writing domain, e.g., RT domain, has 3' to 5' exonuclease activity, e.g., proof-reading activity.

Template Nucleic Acids

The gene modifying systems described herein can modify a host target DNA site using a template nucleic acid sequence. In some embodiments, the gene modifying systems described herein transcribe an RNA sequence template into host target DNA sites by target-primed reverse transcription (TPRT). By modifying DNA sequence(s) via reverse transcription of the RNA sequence template directly into the host genome, the gene modifying system can insert an object sequence into a target genome without the need for exogenous DNA sequences to be introduced into the host cell (unlike, for example, CRISPR systems), as well as eliminate an exogenous DNA insertion step. The gene modifying system can also delete a sequence from the target genome or introduce a substitution using an object sequence. Therefore, the gene modifying system provides a platform for the use of customized RNA sequence templates containing object sequences, e.g., sequences comprising heterologous gene coding and/or function information.

In some embodiments, the template nucleic acid comprises one or more sequence (e.g., 2 sequences) that binds the gene modifying polypeptide.

In some embodiments a system or method described herein comprises a single template nucleic acid (e.g., template RNA). In some embodiments a system or method described herein comprises a plurality of template nucleic acids (e.g., template RNAs). For example, a system described herein comprises a first RNA comprising (e.g., from 5' to 3') a sequence that binds the gene modifying polypeptide (e.g., the DNA-binding domain and/or the endonuclease domain, e.g., a gRNA) and a sequence that binds a target site (e.g., a second strand of a site in a target genome), and a second RNA (e.g., a template RNA) comprising (e.g., from 5' to 3') optionally a sequence that binds the gene modifying polypeptide (e.g., that specifically binds the RT domain), a heterologous object sequence, and a PBS sequence. In some embodiments, when the system comprises a plurality of nucleic acids, each nucleic acid comprises a conjugating domain. In some embodiments, a conjugating domain enables association of nucleic acid molecules, e.g., by hybridization of complementary sequences. For example, in some embodiments a first RNA comprises a first conjugating domain and a second RNA comprises a second conjugating domain, and the first and second conjugating domains are capable of hybridizing to one another, e.g., under stringent conditions. In some embodiments, the stringent conditions for hybridization include hybridization in 4× sodium chloride/sodium citrate (SSC), at about 65 C, followed by a wash in 1×SSC, at about 65 C.

In some embodiments, the template nucleic acid comprises RNA. In some embodiments, the template nucleic acid comprises DNA (e.g., single stranded or double stranded DNA).

In some embodiments, the template nucleic acid comprises one or more (e.g., 2) homology domains that have homology to the target sequence. In some embodiments, the homology domains are about 10-20, 20-50, or 50-100 nucleotides in length.

In some embodiments, a template RNA can comprise a gRNA sequence, e.g., to direct the gene modifying polypeptide to a target site of interest. In some embodiments, a template RNA comprises (e.g., from 5' to 3') (i) optionally a gRNA spacer that binds a target site (e.g., a second strand of a site in a target genome), (ii) optionally a gRNA scaffold that binds a polypeptide described herein (e.g., a gene modifying polypeptide or a Cas polypeptide), (iii) a heterologous object sequence comprising a mutation region (optionally the heterologous object sequence comprises, from 5' to 3', a first homology region, a mutation region, and a second homology region), and (iv) a primer binding site (PBS) sequence comprising a 3' target homology domain.

The template nucleic acid (e.g., template RNA) component of a genome editing system described herein typically is able to bind the gene modifying polypeptide of the system. In some embodiments the template nucleic acid (e.g., template RNA) has a 3' region that is capable of binding a gene modifying polypeptide. The binding region, e.g., 3' region, may be a structured RNA region, e.g., having at least 1, 2 or 3 hairpin loops, capable of binding the gene modifying polypeptide of the system. The binding region may associate the template nucleic acid (e.g., template RNA) with any of the polypeptide modules. In some embodiments, the binding region of the template nucleic acid (e.g., template RNA) may associate with an RNA-binding domain in the polypeptide. In some embodiments, the binding region of the template nucleic acid (e.g., template RNA) may associate with the reverse transcription domain of the gene modifying polypeptide (e.g., specifically bind to the RT domain). In some embodiments, the template nucleic acid (e.g., template RNA) may associate with the DNA binding domain of the polypeptide, e.g., a gRNA associating with a Cas9-derived DNA binding domain. In some embodiments, the binding region may also provide DNA target recognition, e.g., a gRNA hybridizing to the target DNA sequence and binding the polypeptide, e.g., a Cas9 domain. In some embodiments, the template nucleic acid (e.g., template RNA) may associate with multiple components of the polypeptide, e.g., DNA binding domain and reverse transcription domain.

In some embodiments the template RNA has a poly-A tail at the 3' end. In some embodiments the template RNA does not have a poly-A tail at the 3' end.

In some embodiments, the template nucleic acid is a template RNA. In some embodiments, the template RNA comprises one or more modified nucleotides. For example, in some embodiments, the template RNA comprises one or more deoxyribonucleotides. In some embodiments, regions of the template RNA are replaced by DNA nucleotides, e.g., to enhance stability of the molecule. For example, the 3' end of the template may comprise DNA nucleotides, while the rest of the template comprises RNA nucleotides that can be reverse transcribed. For instance, in some embodiments, the heterologous object sequence is primarily or wholly made up of RNA nucleotides (e.g., at least 90%, 95%, 98%, or 99% RNA nucleotides). In some embodiments, the PBS sequence is primarily or wholly made up of DNA nucleotides (e.g., at least 90%, 95%, 98%, or 99% DNA nucleotides). In other embodiments, the heterologous object sequence for writing into the genome may comprise DNA nucleotides. In some embodiments, the DNA nucleotides in the template are copied into the genome by a domain capable of DNA-dependent DNA polymerase activity. In some embodiments, the DNA-dependent DNA polymerase activity is provided by a DNA polymerase domain in the polypeptide. In some embodiments, the DNA-dependent DNA polymerase activity is provided by a reverse transcriptase domain that is also capable of DNA-dependent DNA polymerization, e.g., second strand synthesis. In some embodiments, the template molecule is composed of only DNA nucleotides.

In some embodiments, a system described herein comprises two nucleic acids which together comprise the sequences of a template RNA described herein. In some embodiments, the two nucleic acids are associated with each other non-covalently, e.g., directly associated with each other (e.g., via base pairing), or indirectly associated as part of a complex comprising one or more additional molecule.

A template RNA described herein may comprise, from 5' to 3': (1) a gRNA spacer; (2) a gRNA scaffold; (3) heterologous object sequence (4) a primer binding site (PBS) sequence. Each of these components is now described in more detail.

gRNA Spacer and gRNA Scaffold

A template RNA described herein may comprise a gRNA spacer that directs the gene modifying system to a target nucleic acid, and a gRNA scaffold that promotes association of the template RNA with the Cas domain of the gene modifying polypeptide. The systems described herein can also comprise a gRNA that is not part of a template nucleic acid. For example, a gRNA that comprises a gRNA spacer and gRNA scaffold, but not a heterologous object sequence or a PBS sequence, can be used, e.g., to induce second strand nicking, e.g., as described in the section herein entitled "Second Strand Nicking".

In some embodiments, the gRNA is a short synthetic RNA composed of a scaffold sequence that participates in CRISPR-associated protein binding and a user-defined ~20 nucleotide targeting sequence for a genomic target. The structure of a complete gRNA was described by Nishimasu et al. Cell 156, P935-949 (2014). The gRNA (also referred to as sgRNA for single-guide RNA) consists of crRNA- and tracrRNA-derived sequences connected by an artificial tetraloop. The crRNA sequence can be divided into guide (20 nt) and repeat (12 nt) regions, whereas the tracrRNA sequence can be divided into anti-repeat (14 nt) and three tracrRNA stem loops (Nishimasu et al. Cell 156, P935-949 (2014)). In practice, guide RNA sequences are generally designed to have a length of between 17-24 nucleotides (e.g., 19, 20, or 21 nucleotides) and be complementary to a targeted nucleic acid sequence. Custom gRNA generators and algorithms are available commercially for use in the design of effective guide RNAs. In some embodiments, the gRNA comprises two RNA components from the native CRISPR system, e.g. crRNA and tracrRNA. As is well known in the art, the gRNA may also comprise a chimeric, single guide RNA (sgRNA) containing sequence from both a tracrRNA (for binding the nuclease) and at least one crRNA (to guide the nuclease to the sequence targeted for editing/binding). Chemically modified sgRNAs have also been demonstrated to be effective for use with CRISPR-associated proteins; see, for example, Hendel et al. (2015) Nature Biotechnol., 985-991. In some embodiments, a gRNA spacer comprises a nucleic acid sequence that is complementary to a DNA sequence associated with a target gene.

In some embodiments, the region of the template nucleic acid, e.g., template RNA, comprising the gRNA adopts an underwound ribbon-like structure of gRNA bound to target DNA (e.g., as described in Mulepati et al. Science 19 Sep. 2014: Vol. 345, Issue 6203, pp. 1479-1484). Without wishing to be bound by theory, this non-canonical structure is thought to be facilitated by rotation of every sixth nucleotide out of the RNA-DNA hybrid. Thus, in some embodiments, the region of the template nucleic acid, e.g., template RNA, comprising the gRNA may tolerate increased mismatching with the target site at some interval, e.g., every sixth base. In some embodiments, the region of the template nucleic acid, e.g., template RNA, comprising the gRNA comprising homology to the target site may possess wobble positions at a regular interval, e.g., every sixth base, that do not need to base pair with the target site.

In some embodiments, the template nucleic acid (e.g., template RNA) has at least 15, 16, 17, 18, 19, 20, 21, 22, 23, or 24 bases of at least 80%, 85%, 90%, 95%, 99%, or 100% homology to the target site, e.g., at the 5' end, e.g., comprising a gRNA spacer sequence of length appropriate to the Cas9 domain of the gene modifying polypeptide (Table 8).

In some embodiments, a Cas9 derivative with enhanced activity may be used in the gene modification polypeptide. In some embodiments, a Cas9 derivative may comprise mutations that improve activity of the HNH endonuclease domain, e.g., SpyCas9 R221K, N394K, or mutations that improve R-loop formation, e.g., SpyCas9 L1245V, or comprise a combination of such mutations, e.g., SpyCas9 R221K/N394K, SpyCas9 N394K/L1245V, SpyCas9 R221K/L1245V, or SpyCas9 R221K/N394K/L1245V (see, e.g., Spencer and Zhang Sci Rep 7:16836 (2017), the Cas9 derivatives and comprising mutations of which are incorporated herein by reference). In some embodiments, a Cas9 derivative may comprise one or more types of mutations described herein, e.g., PAM-modifying mutations, protein stabilizing mutations, activity enhancing mutations, and/or mutations partially or fully inactivating one or two endonuclease domains relative to the parental enzyme (e.g., one or more mutations to abolish endonuclease activity towards one or both strands of a target DNA, e.g., a nickase or catalytically dead enzyme). In some embodiments, a Cas9 enzyme used in a system described herein may comprise mutations that confer nickase activity toward the enzyme (e.g., SpyCas9 N863A or H840A) in addition to mutations improving catalytic efficiency (e.g., SpyCas9 R221K, N394K, and/or L1245V). In some embodiments, a Cas9 enzyme used in a system described herein is a SpyCas9 enzyme or derivative that further comprises an N863A mutation to confer nickase activity in addition to R221K and N394K mutations to improve catalytic efficiency.

Table 12 provides parameters to define components for designing gRNA and/or Template RNAs to apply Cas variants listed in Table 8 for gene modifying. The cut site indicates the validated or predicted protospacer adjacent motif (PAM) requirements, validated or predicted location of cut site (relative to the most upstream base of the PAM site). The gRNA for a given enzyme can be assembled by concatenating the crRNA, Tetraloop, and tracrRNA sequences, and further adding a 5' spacer of a length within Spacer (min) and Spacer (max) that matches a protospacer at a target site. Further, the predicted location of the ssDNA nick at the target is important for designing a PBS sequence of a Template RNA that can anneal to the sequence immediately 5' of the nick in order to initiate target primed reverse transcription. In some embodiments, a gRNA scaffold described herein comprises a nucleic acid sequence comprising, in the 5' to 3' direction, a crRNA of Table 12, a tetraloop from the same row of Table 12, and a tracrRNA from the same row of Table 12, or a sequence having at least 70%, 80%, 85%, 90%, 95%, or 99% identity thereto. In some embodiments, the gRNA or template RNA comprising the scaffold further comprises a gRNA spacer having a length within the Spacer (min) and Spacer (max) indicated in the same row of Table 12. In some embodiments, the gRNA or template RNA having a sequence according to Table 12 is comprised by a system that further comprises a gene modifying polypeptide, wherein the gene modifying polypeptide comprises a Cas domain described in the same row of Table 12.

TABLE 12

Parameters to define components for designing gRNA and/or Template RNAs to apply Cas variants listed in Table 8 in gene modifying systems.

| Variant | PAM(s) | Cut | Tier | Spacer (min) | Spacer (max) | crRNA | SEQ ID NO: | Tetra-loop | tracrRNA | SEQ ID NO: |
|---|---|---|---|---|---|---|---|---|---|---|
| Nme2Cas9 | NNNNCC | -3 | 1 | 22 | 24 | GTTGTAGCTCCCTTTCTCATTTCG | 10,051 | GAAA | CGAAATGAGAACCGTTGCTACAATAAGGCCGTCTGAAAAGATGTGCCGCAACGCTCTGCCCCTTAAAGCTTCTGCTTTAAGGGGCATCGTTTA | 10,151 |

TABLE 12-continued

Parameters to define components for designing gRNA and/or Template RNAs to apply Cas variants listed in Table 8 in gene modifying systems.

| Variant | PAM(s) | Cut | Tier | Spacer (min) | Spacer (max) | crRNA | SEQ ID NO: | Tetra-loop | tracrRNA | SEQ ID NO: |
|---|---|---|---|---|---|---|---|---|---|---|
| PpnCas9 | NNNNRTT | | 1 | 21 | 24 | GTTGTAGC TCCCTTTTT CATTTCGC | 10,052 | GAAA | GCGAAATGAAAAACGTTGTTACAATAAGA GATGAATTTCTCGCAAAGCTCTGCCTCTTG AAATTTCGGTTTCAAGAGGCATC | 10,152 |
| SauCas9 | NNGRR; NNGRRT | -3 | 1 | 21 | 23 | GTTTTAGT ACTCTG | 10,053 | GAAA | CAGAATCTACTAAAACAAGGCAAAATGCC GTGTTTATCTCGTCAACTTGTTGGCGAGA | 10,153 |
| SauCas9-KKH | NNNRR; NNNRRT | -3 | 1 | 21 | 21 | GTTTTAGT ACTCTG | 10,054 | GAAA | CAGAATCTACTAAAACAAGGCAAAATGCC GTGTTTATCTCGTCAACTTGTTGGCGAGA | 10,154 |
| SauriCas9 | NNGG | -3 | 1 | 21 | 21 | GTTTTAGT ACTCTG | 10,055 | GAAA | CAGAATCTACTAAAACAAGGCAAAATGCC GTGTTTATCTCGTCAACTTGTTGGCGAGA | 10,155 |
| SauriCas9-KKH | NNRG | -3 | 1 | 21 | 21 | GTTTTAGT ACTCTG | 10,056 | GAAA | CAGAATCTACTAAAACAAGGCAAAATGCC GTGTTTATCTCGTCAACTTGTTGGCGAGA | 10,156 |
| ScaCas9-Sc++ | NNG | -3 | 1 | 20 | 20 | GTTTTAGA GCTA | 10,057 | GAAA | TAGCAAGTTAAAATAAGGCTAGTCCGTTA TCAACTTGAAAAAGTGGCACCGAGTCGGT GC | 10,157 |
| SpyCas9 | NGG | -3 | 1 | 20 | 20 | GTTTTAGA GCTA | 10,058 | GAAA | TAGCAAGTTAAAATAAGGCTAGTCCGTTA TCAACTTGAAAAAGTGGCACCGAGTCGGT GC | 10,158 |
| SpyCas9_ i_v1 | NGG | -3 | 1 | 20 | 20 | GTTTTAGA GCTA | 10,058 | GAAA | TAGCAAGTTAAAATAAGGCTAGTCCGTTA TCAACTTGGACTTCGGTCCAAGTGGCACC GAGTCGGTGC | 10,193 |
| SpyCas9_ i_v2 | NGG | -3 | 1 | 20 | 20 | GTTTTAGA GCTA | 10,058 | GAAA | TAGCAAGTTAAAATAAGGCTAGTCCGTTA TCAACTTGGAGCTTGCTCCAAGTGGCACC GAGTCGGTGC | 10,194 |
| SpyCas9_ i_v3 | NGG | -3 | 1 | 20 | 20 | GTTTTAGA GCTA | 10,058 | GAAA | GTTTTAGAGCTAGAAATAGCAAGTTAAAA TAAGGCTAGTCCGTTATCGACTTGAAAAA GTCGCACCGAGTCGGTGC | 10,195 |
| SpyCas9-NG | NG (NGG = NGA = NGT > NGC) | -3 | 1 | 20 | 20 | GTTTTAGA GCTA | 10,059 | GAAA | TAGCAAGTTAAAATAAGGCTAGTCCGTTA TCAACTTGAAAAAGTGGCACCGAGTCGGT GC | 10,159 |
| SpyCas9-SpRY | NRN > NYN | -3 | 1 | 20 | 20 | GTTTTAGA GCTA | 10,060 | GAAA | TAGCAAGTTAAAATAAGGCTAGTCCGTTA TCAACTTGAAAAAGTGGCACCGAGTCGGT GC | 10,160 |
| St1Cas9 | NNAGAAW > NNAGGAW = NNGGAAW | -3 | 1 | 20 | 20 | GTCTTTGTA CTCTG | 10,061 | GTAC | CAGAAGCTACAAAGATAAGGCTTCATGCC GAAATCAACACCCTGTCATTTTATGGCAG GGTGTTTT | 10,161 |
| BlatCas9 | NNNNCNAA > NNNNCNDD > NNNNC | -3 | 1 | 19 | 23 | GCTATAGT TCCTTACT | 10,062 | GAAA | GGTAAGTTGCTATAGTAAGGGCAACAGAC CCGAGGCGTTGGGGATCGCCTAGCCCGTG TTTACGGGCTCTCCCCATATTCAAAATAAT GACAGACGAGCACCTTGGAGCATTTATCT CCGAGGTGCT | 10,162 |
| cCas9-v16 | NNVACT; NNVATGM; NNVATT; NNVGCT; NNVGTG; NNVGTT | -3 | 2 | 21 | 21 | GTCTTAGT ACTCTG | 10,063 | GAAA | CAGAATCTACTAAGACAAGGCAAAATGCC GTGTTTATCTCGTCAACTTGTTGGCGAGA | 10,163 |
| cCas9-v17 | NNVRRN | -3 | 2 | 21 | 21 | GTCTTAGT ACTCTG | 10,064 | GAAA | CAGAATCTACTAAGACAAGGCAAAATGCC GTGTTTATCTCGTCAACTTGTTGGCGAGA | 10,164 |
| cCas9-v21 | NNVACT; NNVATGM; NNVATT; NNVGCT; NNVGTG; NNVGTT | -3 | 2 | 21 | 21 | GTCTTAGT ACTCTG | 10,065 | GAAA | CAGAATCTACTAAGACAAGGCAAAATGCC GTGTTTATCTCGTCAACTTGTTGGCGAGA | 10,165 |

TABLE 12-continued

Parameters to define components for designing gRNA and/or Template RNAs to apply Cas variants listed in Table 8 in gene modifying systems.

| Variant | PAM(s) | Cut | Tier | Spacer (min) | Spacer (max) | crRNA | SEQ ID NO: | Tetra-loop | tracrRNA | SEQ ID NO: |
|---|---|---|---|---|---|---|---|---|---|---|
| cCas9-v42 | NNVRRN | -3 | 2 | 21 | 21 | GTCTTAGT ACTCTG | 10,066 | GAAA | CAGAATCTACTAAGACAAGGCAAAATGCC GTGTTTATCTCGTCAACTTGTTGGCGAGA | 10,166 |
| CdiCas9 | NNRHHHY; NNRAAAY | | 2 | 22 | 22 | ACTGGGGT TCAG | 10,067 | GAAA | CTGAACCTCAGTAAGCATTGGCTCGTTTCC AATGTTGATTGCTCCGCCGGTGCTCCTTAT TTTTAAGGGCGCCGGC | 10,167 |
| CjeCas9 | NNNNRYAC | -3 | 2 | 21 | 23 | GTTTTAGTC CCT | 10,068 | GAAA | AGGGACTAAAATAAAGAGTTTGCGGGACT CTGCGGGGTTACAATCCCCTAAAACCGC | 10,168 |
| GeoCas9 | NNNNCRAA | | 2 | 21 | 23 | GTCATAGT TCCCCTGA | 10,069 | GAAA | TCAGGGTTACTATGATAAGGGCTTTCTGCC TAAGGCAGACTGACCCGCGGCGTTGGGG ATCGCCTGTCGCCCGCTTTTGGCGGGCATT CCCCATCCTT | 10,169 |
| iSpyMacCas9 | NAAN | -3 | 2 | 19 | 21 | GTTTTAGA GCTA | 10,070 | GAAA | TAGCAAGTTAAAATAAGGCTAGTCCGTTA TCAACTTGAAAAAGTGGCACCGAGTCGGT GC | 10,170 |
| NmeCas9 | NNNNGAYT; NNNNGYTT; NNNNGAYA; NNNNGTCT | -3 | 2 | 20 | 24 | GTTGTAGC TCCCTTTCT CATTTCG | 10,071 | GAAA | CGAAATGAGAACCGTTGCTACAATAAGGC CGTCTGAAAAGATGTGCCGCAACGCTCTG CCCCTTAAAGCTTCTGCTTTAAGGGGCATC GTTTA | 10,171 |
| ScaCas9 | NNG | -3 | 2 | 20 | 20 | GTTTTAGA GCTA | 10,072 | GAAA | TAGCAAGTTAAAATAAGGCTAGTCCGTTA TCAACTTGAAAAAGTGGCACCGAGTCGGT GC | 10,172 |
| ScaCas9-HiFi-Sc++ | NNG | -3 | 2 | 20 | 20 | GTTTTAGA GCTA | 10,073 | GAAA | TAGCAAGTTAAAATAAGGCTAGTCCGTTA TCAACTTGAAAAAGTGGCACCGAGTCGGT GC | 10,173 |
| SpyCas9-3var-NRRH | NRRH | -3 | 2 | 20 | 20 | GTTTAAGA GCTATGCT G | 10,074 | GAAA | CAGCATAGCAAGTTTAAATAAGGCTAGTC CGTTATCAACTTGAAAAAGTGGCACCGAG TCGGTGC | 10,174 |
| SpyCas9-3var-NRTH | NRTH | -3 | 2 | 20 | 20 | GTTTAAGA GCTATGCT G | 10,075 | GAAA | CAGCATAGCAAGTTTAAATAAGGCTAGTC CGTTATCAACTTGAAAAAGTGGCACCGAG TCGGTGC | 10,175 |
| SpyCas9-3var-NRCH | NRCH | -3 | 2 | 20 | 20 | GTTTAAGA GCTATGCT G | 10,076 | GAAA | CAGCATAGCAAGTTTAAATAAGGCTAGTC CGTTATCAACTTGAAAAAGTGGCACCGAG TCGGTGC | 10,176 |
| SpyCas9-HF1 | NGG | -3 | 2 | 20 | 20 | GTTTTAGA GCTA | 10,077 | GAAA | TAGCAAGTTAAAATAAGGCTAGTCCGTTA TCAACTTGAAAAAGTGGCACCGAGTCGGT GC | 10,177 |
| SpyCas9-QQR1 | NAAG | -3 | 2 | 20 | 20 | GTTTTAGA GCTA | 10,078 | GAAA | TAGCAAGTTAAAATAAGGCTAGTCCGTTA TCAACTTGAAAAAGTGGCACCGAGTCGGT GC | 10,178 |
| SpyCas9-SpG | NGN | -3 | 2 | 20 | 20 | GTTTTAGA GCTA | 10,079 | GAAA | TAGCAAGTTAAAATAAGGCTAGTCCGTTA TCAACTTGAAAAAGTGGCACCGAGTCGGT GC | 10,179 |
| SpyCas9-VQR | NGAN | -3 | 2 | 20 | 20 | GTTTTAGA GCTA | 10,080 | GAAA | TAGCAAGTTAAAATAAGGCTAGTCCGTTA TCAACTTGAAAAAGTGGCACCGAGTCGGT GC | 10,180 |
| SpyCas9-VRER | NGCG | -3 | 2 | 20 | 20 | GTTTTAGA GCTA | 10,081 | GAAA | TAGCAAGTTAAAATAAGGCTAGTCCGTTA TCAACTTGAAAAAGTGGCACCGAGTCGGT GC | 10,181 |
| SpyCas9-xCas | NG;GAA; GAT | -3 | 2 | 20 | 20 | GTTTAAGA GCTATGCT G | 10,082 | GAAA | CAGCATAGCAAGTTTAAATAAGGCTAGTC CGTTATCAACTTGAAAAAGTGGCACCGAG TCGGTGC | 10,182 |
| SpyCas9-xCas-NG | NG | -3 | 2 | 20 | 20 | GTTTAAGA GCTATGCT G | 10,083 | GAAA | CAGCATAGCAAGTTTAAATAAGGCTAGTC CGTTATCAACTTGAAAAAGTGGCACCGAG TCGGTGC | 10,183 |

TABLE 12-continued

Parameters to define components for designing gRNA and/or Template RNAs to apply Cas variants listed in Table 8 in gene modifying systems.

| Variant | PAM(s) | Cut | Tier | Spacer (min) | Spacer (max) | crRNA | SEQ ID NO: | Tetra-loop | tracrRNA | SEQ ID NO: |
|---|---|---|---|---|---|---|---|---|---|---|
| St1Cas9-CNRZ1066 | NNACAA | -3 | 2 | 20 | 20 | GTCTTTGTACTCTG | 10,084 | GTAC | CAGAAGCTACAAAGATAAGGCTTCATGCCGAAATCAACACCCTGTCATTTTATGGCAGGGTGTTTT | 10,184 |
| St1Cas9-LMG1831 | NNGCAA | -3 | 2 | 20 | 20 | GTCTTTGTACTCTG | 10,085 | GTAC | CAGAAGCTACAAAGATAAGGCTTCATGCCGAAATCAACACCCTGTCATTTTATGGCAGGGTGTTTT | 10,185 |
| St1Cas9-MTH17CL396 | NNAAAA | -3 | 2 | 20 | 20 | GTCTTTGTACTCTG | 10,086 | GTAC | CAGAAGCTACAAAGATAAGGCTTCATGCCGAAATCAACACCCTGTCATTTTATGGCAGGGTGTTTT | 10,186 |
| St1Cas9-TH1477 | NNGAAA | -3 | 2 | 20 | 20 | GTCTTTGTACTCTG | 10,087 | GTAC | CAGAAGCTACAAAGATAAGGCTTCATGCCGAAATCAACACCCTGTCATTTTATGGCAGGGTGTTTT | 10,187 |
| SRGN3.1 | NNGG | | 1 | 21 | 23 | GTTTTAGTACTCTG | 10,088 | GAAA | CAGAATCTACTGAAACAAGACAATATGTCGTGTTTATCCCATCAATTTATTGGTGGGATTTT | 10,188 |
| sRGN3.3 | NNGG | | 1 | 21 | 23 | GTTTTAGTACTCTG | 10,089 | GAAA | CAGAATCTACTGAAACAAGACAATATGTCGTGTTTATCCCATCAATTTATTGGTGGGATTTT | 10,189 |

Herein, when an RNA sequence (e.g., a template RNA sequence) is said to comprise a particular sequence (e.g., a sequence of Table 12 or a portion thereof) that comprises thymine (T), it is of course understood that the RNA sequence may (and frequently does) comprise uracil (U) in place of T. For instance, the RNA sequence may comprise U at every position shown as T in the sequence in Table 12. More specifically, the present disclosure provides an RNA sequence according to every gRNA scaffold sequence of Table 12, wherein the RNA sequence has a U in place of each T in the sequence in Table 12. Additionally, it is understood that terminal Us and Ts may optionally be added or removed from tracrRNA sequences and may be modified or unmodified when provided as RNA. Without wishing to be bound by example, versions of gRNA scaffold sequences alternative to those exemplified in Table 12 may also function with the different Cas9 enzymes or derivatives thereof exemplified in Table 8, e.g., alternate gRNA scaffold sequences with nucleotide additions, substitutions, or deletions, e.g., sequences with stem-loop structures added or removed. It is contemplated herein that the gRNA scaffold sequences represent a component of gene modifying systems that can be similarly optimized for a given system, Cas-RT fusion polypeptide, indication, target mutation, template RNA, or delivery vehicle.

Heterologous Object Sequence

A template RNA described herein may comprise a heterologous object sequence that the gene modifying polypeptide can use as a template for reverse transcription, to write a desired sequence into the target nucleic acid. In some embodiments, the heterologous object sequence comprises, from 5' to 3', a post-edit homology region, the mutation region, and a pre-edit homology region. Without wishing to be bound by theory, an RT performing reverse transcription on the template RNA first reverse transcribes the pre-edit homology region, then the mutation region, and then the post-edit homology region, thereby creating a DNA strand comprising the desired mutation with a homology region on either side.

In some embodiments, the heterologous object sequence is at least 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 120, 140, 160, 180, 200, 500, or 1,000 nucleotides (nts) in length, or at least 1, 1.5, 2, 2.5, 3, 3.5, 4, 4.5, 5, 5.5, 6, 6.5, 7, 7.5, 8, 8.5, 9, 9.5, or 10 kilobases in length. In some embodiments, the heterologous object sequence is no more than 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 120, 140, 160, 180, 200, 500, 1,000, or 2000 nucleotides (nts) in length, or no more than 20, 15, 10, 9, 8, 7, 6, 5, 4, or 3 kilobases in length. In some embodiments, the heterologous object sequence is 30-1000, 40-1000, 50-1000, 60-1000, 70-1000, 74-1000, 75-1000, 76-1000, 77-1000, 78-1000, 79-1000, 80-1000, 85-1000, 90-1000, 100-1000, 120-1000, 140-1000, 160-1000, 180-1000, 200-1000, 500-1000, 30-500, 40-500, 50-500, 60-500, 70-500, 74-500, 75-500, 76-500, 77-500, 78-500, 79-500, 80-500, 85-500, 90-500, 100-500, 120-500, 140-500, 160-500, 180-500, 200-500, 30-200, 40-200, 50-200, 60-200, 70-200, 74-200, 75-200, 76-200, 77-200, 78-200, 79-200, 80-200, 85-200, 90-200, 100-200, 120-200, 140-200, 160-200, 180-200, 30-100, 40-100, 50-100, 60-100, 70-100, 74-100, 75-100, 76-100, 77-100, 78-100, 79-100, 80-100, 85-100, or 90-100 nucleotides (nts) in length, or 1-20, 1-15, 1-10, 1-9, 1-8, 1-7, 1-6, 1-5, 1-4, 1-3, 1-2, 2-20, 2-15, 2-10, 2-9, 2-8, 2-7, 2-6, 2-5, 2-4, 2-3, 3-20, 3-15, 3-10, 3-9, 3-8, 3-7, 3-6, 3-5, 3-4, 4-20, 4-15, 4-10, 4-9, 4-8, 4-7, 4-6, 4-5, 5-20, 5-15, 5-10, 5-9, 5-8, 5-7, 5-6, 6-20, 6-15, 6-10, 6-9, 6-8, 6-7, 7-20, 7-15, 7-10, 7-9, 7-8, 8-20, 8-15, 8-10, 8-9, 9-20, 9-15, 9-10, 10-15, 10-20, or 15-20 kilobases in length. In some embodiments, the heterologous object sequence is 10-100, 10-90, 10-80, 10-70, 10-60, 10-50, 10-40, 10-30, or 10-20 nt in length, e.g., 10-80, 10-50, or 10-20 nt in length, e.g., about 10-20 nt in length. In some embodiments, the heterologous object sequence is 8-30, 9-25, 10-20, 11-16, or 12-15 nucleotides in length, e.g., is 11-16 nt in length. Without wishing to be bound by theory, in some embodiments, a larger insertion size, larger region of editing (e.g., the distance between a first edit/substitution and a second edit/substitution in the target region), and/or greater number of desired edits (e.g., mismatches of the heterologous object sequence to the target genome), may result in a longer optimal heterologous object sequence.

In certain embodiments, the template nucleic acid comprises a customized RNA sequence template which can be identified, designed, engineered and constructed to contain sequences altering or specifying host genome function, for example by introducing a heterologous coding region into a genome; affecting or causing exon structure/alternative splicing, e.g., leading to exon skipping of one or more exons; causing disruption of an endogenous gene, e.g., creating a genetic knockout; causing transcriptional activation of an endogenous gene; causing epigenetic regulation of an endogenous DNA; causing up-regulation of one or more operably linked genes, e.g., leading to gene activation or overexpression; causing down-regulation of one or more operably linked genes, e.g., creating a genetic knock-down; etc. In certain embodiments, a customized RNA sequence template can be engineered to contain sequences coding for exons and/or transgenes, provide binding sites for transcription factor activators, repressors, enhancers, etc., and combinations thereof. In some embodiments, a customized template can be engineered to encode a nucleic acid or peptide tag to be expressed in an endogenous RNA transcript or endogenous protein operably linked to the target site. In other embodiments, the coding sequence can be further customized with splice donor sites, splice acceptor sites, or poly-A tails.

The template nucleic acid (e.g., template RNA) of the system typically comprises an object sequence (e.g., a heterologous object sequence) for writing a desired sequence into a target DNA. The object sequence may be coding or non-coding. The template nucleic acid (e.g., template RNA) can be designed to result in insertions, mutations, or deletions at the target DNA locus. In some embodiments, the template nucleic acid (e.g., template RNA) may be designed to cause an insertion in the target DNA. For example, the template nucleic acid (e.g., template RNA) may contain a heterologous sequence, wherein the reverse transcription will result in insertion of the heterologous sequence into the target DNA. In other embodiments, the RNA template may be designed to introduce a deletion into the target DNA. For example, the template nucleic acid (e.g., template RNA) may match the target DNA upstream and downstream of the desired deletion, wherein the reverse transcription will result in the copying of the upstream and downstream sequences from the template nucleic acid (e.g., template RNA) without the intervening sequence, e.g., causing deletion of the intervening sequence. In other embodiments, the template nucleic acid (e.g., template RNA) may be designed to introduce an edit into the target DNA. For example, the template RNA may match the target DNA sequence with the exception of one or more nucleotides, wherein the reverse transcription will result in the copying of these edits into the target DNA, e.g., resulting in mutations, e.g., transition or transversion mutations.

In some embodiments, writing of an object sequence into a target site results in the substitution of nucleotides, e.g., where the full length of the object sequence corresponds to a matching length of the target site with one or more mismatched bases. In some embodiments, a heterologous object sequence may be designed such that a combination of sequence alterations may occur, e.g., a simultaneous addition and deletion, addition and substitution, or deletion and substitution.

In some embodiments, the heterologous object sequence may contain an open reading frame or a fragment of an open reading frame. In some embodiments the heterologous object sequence has a Kozak sequence. In some embodiments the heterologous object sequence has an internal ribosome entry site. In some embodiments the heterologous object sequence has a self-cleaving peptide such as a T2A or P2A site. In some embodiments the heterologous object sequence has a start codon. In some embodiments the template RNA has a splice acceptor site. In some embodiments the template RNA has a splice donor site. Exemplary splice acceptor and splice donor sites are described in WO2016044416, incorporated herein by reference in its entirety. Exemplary splice acceptor site sequences are known to those of skill in the art. In some embodiments the template RNA has a microRNA binding site downstream of the stop codon. In some embodiments the template RNA has a polyA tail downstream of the stop codon of an open reading frame. In some embodiments the template RNA comprises one or more exons. In some embodiments the template RNA comprises one or more introns. In some embodiments the template RNA comprises a eukaryotic transcriptional terminator. In some embodiments the template RNA comprises an enhanced translation element or a translation enhancing element. In some embodiments the RNA comprises the human T-cell leukemia virus (HTLV-1) R region. In some embodiments the RNA comprises a posttranscriptional regulatory element that enhances nuclear export, such as that of Hepatitis B Virus (HPRE) or Woodchuck Hepatitis Virus (WPRE).

In some embodiments, the heterologous object sequence may contain a non-coding sequence. For example, the template nucleic acid (e.g., template RNA) may comprise a regulatory element, e.g., a promoter or enhancer sequence or miRNA binding site. In some embodiments, integration of the object sequence at a target site will result in upregulation of an endogenous gene. In some embodiments, integration of the object sequence at a target site will result in down-regulation of an endogenous gene. In some embodiments the template nucleic acid (e.g., template RNA) comprises a tissue specific promoter or enhancer, each of which may be unidirectional or bidirectional. In some embodiments the promoter is an RNA polymerase I promoter, RNA polymerase II promoter, or RNA polymerase III promoter. In some embodiments the promoter comprises a TATA element. In some embodiments the promoter comprises a B recognition element. In some embodiments the promoter has one or more binding sites for transcription factors.

In some embodiments, the template nucleic acid (e.g., template RNA) comprises a site that coordinates epigenetic modification. In some embodiments, the template nucleic acid (e.g., template RNA) comprises a chromatin insulator. For example, the template nucleic acid (e.g., template RNA) comprises a CTCF site or a site targeted for DNA methylation.

In some embodiments, the template nucleic acid (e.g., template RNA) comprises a gene expression unit composed of at least one regulatory region operably linked to an effector sequence. The effector sequence may be a sequence that is transcribed into RNA (e.g., a coding sequence or a non-coding sequence such as a sequence encoding a micro RNA).

In some embodiments, the heterologous object sequence of the template nucleic acid (e.g., template RNA) is inserted into a target genome in an endogenous intron. In some embodiments, the heterologous object sequence of the template nucleic acid (e.g., template RNA) is inserted into a target genome and thereby acts as a new exon. In some embodiments, the insertion of the heterologous object sequence into the target genome results in replacement of a natural exon or the skipping of a natural exon.

The template nucleic acid (e.g., template RNA) can be designed to result in insertions, mutations, or deletions at the target DNA locus. In some embodiments, the template nucleic acid (e.g., template RNA) may be designed to cause an insertion in the target DNA. For example, the template nucleic acid (e.g., template RNA) may contain a heterologous object sequence, wherein the reverse transcription will result in insertion of the heterologous object sequence into the target DNA. In other embodiments, the RNA template may be designed to write a deletion into the target DNA. For example, the template nucleic acid (e.g., template RNA) may match the target DNA upstream and downstream of the desired deletion, wherein the reverse transcription will result in the copying of the upstream and downstream sequences from the template nucleic acid (e.g., template RNA) without the intervening sequence, e.g., causing deletion of the intervening sequence. In other embodiments, the template nucleic acid (e.g., template RNA) may be designed to write an edit into the target DNA. For example, the template RNA may match the target DNA sequence with the exception of one or more nucleotides, wherein the reverse transcription will result in the copying of these edits into the target DNA, e.g., resulting in mutations, e.g., transition or transversion mutations.

In some embodiments, the pre-edit homology domain comprises a nucleic acid sequence having 100% sequence identity with a nucleic acid sequence comprised in a target nucleic acid molecule.

In some embodiments, the post-edit homology domain comprises a nucleic acid sequence having 100% sequence identity with a nucleic acid sequence comprised in a target nucleic acid molecule.

PBS Sequence

In some embodiments, a template nucleic acid (e.g., template RNA) comprises a PBS sequence. In some embodiments, a PBS sequence is disposed 3' of the heterologous object sequence and is complementary to a sequence adjacent to a site to be modified by a system described herein, or comprises no more than 1, 2, 3, 4, or 5 mismatches to a sequence complementary to the sequence adjacent to a site to be modified by the system/gene modifying polypeptide. In some embodiments, the PBS sequence binds within 1, 2, 3, 4, 5, 6, 7, 8, 9, or 10 nucleotides of a nick site in the target nucleic acid molecule. In some embodiments, binding of the PBS sequence to the target nucleic acid molecule permits initiation of target-primed reverse transcription (TPRT), e.g., with the 3' homology domain acting as a primer for TPRT. In some embodiments, the PBS sequence is 3-5, 5-10, 10-30, 10-25, 10-20, 10-19, 10-18, 10-17, 10-16, 10-15, 10-14, 10-13, 10-12, 10-11, 11-30, 11-25, 11-20, 11-19, 11-18, 11-17, 11-16, 11-15, 11-14, 11-13, 11-12, 12-30, 12-25, 12-20, 12-19, 12-18, 12-17, 12-16, 12-15, 12-14, 12-13, 13-30, 13-25, 13-20, 13-19, 13-18, 13-17, 13-16, 13-15, 13-14, 14-30, 14-25, 14-20, 14-19, 14-18, 14-17, 14-16, 14-15, 15-30, 15-25, 15-20, 15-19, 15-18, 15-17, 15-16, 16-30, 16-25, 16-20, 16-19, 16-18, 16-17, 17-30, 17-25, 17-20, 17-19, 17-18, 18-30, 18-25, 18-20, 18-19, 19-30, 19-25, 19-20, 20-30, 20-25, or 25-30 nucleotides in length, e.g., 10-17, 12-16, or 12-14 nucleotides in length. In some embodiments, the PBS sequence is 5-20, 8-16, 8-14, 8-13, 9-13, 9-12, or 10-12 nucleotides in length, e.g., 9-12 nucleotides in length.

The template nucleic acid (e.g., template RNA) may have some homology to the target DNA. In some embodiments, the template nucleic acid (e.g., template RNA) PBS sequence domain may serve as an annealing region to the target DNA, such that the target DNA is positioned to prime the reverse transcription of the template nucleic acid (e.g., template RNA). In some embodiments the template nucleic acid (e.g., template RNA) has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 175, 200 or more bases of exact homology to the target DNA at the 3' end of the RNA. In some embodiments the template nucleic acid (e.g., template RNA) has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 175, 200 or more bases of at least 50%, 60%, 70%, 80%, 85%, 90%, 95%, 97%, 98%, 99% or 100% homology to the target DNA, e.g., at the 5' end of the template nucleic acid (e.g., template RNA).

Exemplary Template Sequences

In some embodiments of the systems and methods herein, the template RNA comprises a gRNA spacer comprising the core nucleotides of a gRNA spacer sequence of Table 1A, Table 1B, Table 1C, or Table 1D. In some embodiments, the gRNA spacer additionally comprises one or more (e.g., 2, 3, or all) consecutive nucleotides starting with the 3' end of the flanking nucleotides of the gRNA spacer. In some embodiments, the template RNA comprising a sequence of Table 11A, Table 1B, Table 1C, or Table 1D is comprised by a system that further comprises a gene modifying polypeptide having an RT domain listed in the same line of Table 11A, Table 1B, Table 1C, or Table 1D. RT domain amino acid sequences can be found, e.g., in Table 6 herein.

TABLE 1A

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 1 | CCC | TTGCTGCCACAATACCTTGG | 17033 | SpyCas9-SpRY | 0 | 0 |
| 2 | GG | AGCGAACTGAGAAGGGCCAA | 17034 | SpyCas9-NG | 1 | 0 |
| 3 | GG | AGCGAACTGAGAAGGGCCAA | 17035 | SpyCas9-xCas | 1 | 0 |
| 4 | GG | AGCGAACTGAGAAGGGCCAA | 17036 | SpyCas9-xCas-NG | 1 | 0 |
| 5 | GGT | AGCGAACTGAGAAGGGCCAA | 17037 | SpyCas9-SpG | 1 | 0 |
| 6 | GGT | AGCGAACTGAGAAGGGCCAA | 17038 | SpyCas9-SpRY | 1 | 0 |
| 7 | GCC | TTTGCTGCCACAATACCTTG | 17039 | SpyCas9-SpRY | 1 | 0 |
| 8 | GGTA | AGCGAACTGAGAAGGGCCAA | 17040 | SpyCas9-3var-NRTH | 1 | 0 |
| 9 | AGGTATT | CGTAGCGAACTGAGAAGGGCCA | 17041 | CdiCas9 | 2 | 0 |
| 10 | AGGTATT | gtcGTAGCGAACTGAGAAGGGCCA | 17042 | PpnCas9 | 2 | 0 |
| 11 | AGG | TAGCGAACTGAGAAGGGCCA | 17043 | ScaCas9 | 2 | 0 |
| 12 | AGG | TAGCGAACTGAGAAGGGCCA | 17044 | ScaCas9-HiFi-Sc++ | 2 | 0 |
| 13 | AGG | TAGCGAACTGAGAAGGGCCA | 17045 | ScaCas9-Sc++ | 2 | 0 |
| 14 | AGG | TAGCGAACTGAGAAGGGCCA | 17046 | SpyCas9 | 2 | 0 |
| 15 | AGG | TAGCGAACTGAGAAGGGCCA | 17047 | SpyCas9-HF1 | 2 | 0 |
| 16 | AGG | TAGCGAACTGAGAAGGGCCA | 17048 | SpyCas9-SpG | 2 | 0 |
| 17 | AGG | TAGCGAACTGAGAAGGGCCA | 17049 | SpyCas9-SpRY | 2 | 0 |
| 18 | GG | CTTTGCTGCCACAATACCTT | 17050 | SpyCas9-NG | 2 | 0 |
| 19 | GG | CTTTGCTGCCACAATACCTT | 17051 | SpyCas9-xCas | 2 | 0 |
| 20 | GG | CTTTGCTGCCACAATACCTT | 17052 | SpyCas9-xCas-NG | 2 | 0 |
| 21 | AG | TAGCGAACTGAGAAGGGCCA | 17053 | SpyCas9-NG | 2 | 0 |
| 22 | AG | TAGCGAACTGAGAAGGGCCA | 17054 | SpyCas9-xCas | 2 | 0 |
| 23 | AG | TAGCGAACTGAGAAGGGCCA | 17055 | SpyCas9-xCas-NG | 2 | 0 |
| 24 | GGC | CTTTGCTGCCACAATACCTT | 17056 | SpyCas9-SpG | 2 | 0 |
| 25 | GGC | CTTTGCTGCCACAATACCTT | 17057 | SpyCas9-SpRY | 2 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 26 | GGCCC | gaacTTTGCTGCCACAATACCTT | 17058 | BlatCas9 | 2 | 0 |
| 27 | AGGT | TAGCGAACTGAGAAGGGCCA | 17059 | SpyCas9-3var-NRRH | 2 | 0 |
| 28 | GGCC | CTTTGCTGCCACAATACCTT | 17060 | SpyCas9-3var-NRCH | 2 | 0 |
| 29 | tGGCCC | agGAACTTTGCTGCCACAATACCT | 17061 | Nme2Cas9 | 3 | 1 |
| 30 | aAGG | CGTAGCGAACTGAGAAGGGCC | 17062 | SauriCas9 | 3 | 1 |
| 31 | aAGG | CGTAGCGAACTGAGAAGGGCC | 17063 | SauriCas9-KKH | 3 | 1 |
| 32 | tGG | ACTTTGCTGCCACAATACCT | 17064 | ScaCas9 | 3 | 1 |
| 33 | tGG | ACTTTGCTGCCACAATACCT | 17065 | ScaCas9-HiFi-Sc++ | 3 | 1 |
| 34 | tGG | ACTTTGCTGCCACAATACCT | 17066 | ScaCas9-Sc++ | 3 | 1 |
| 35 | tGG | ACTTTGCTGCCACAATACCT | 17067 | SpyCas9 | 3 | 1 |
| 36 | tGG | ACTTTGCTGCCACAATACCT | 17068 | SpyCas9-HF1 | 3 | 1 |
| 37 | tGG | ACTTTGCTGCCACAATACCT | 17069 | SpyCas9-SpG | 3 | 1 |
| 38 | tGG | ACTTTGCTGCCACAATACCT | 17070 | SpyCas9-SpRY | 3 | 1 |
| 39 | aAG | GTAGCGAACTGAGAAGGGCC | 17071 | ScaCas9 | 3 | 1 |
| 40 | aAG | GTAGCGAACTGAGAAGGGCC | 17072 | ScaCas9-HiFi-Sc++ | 3 | 1 |
| 41 | aAG | GTAGCGAACTGAGAAGGGCC | 17073 | ScaCas9-Sc++ | 3 | 1 |
| 42 | aAG | GTAGCGAACTGAGAAGGGCC | 17074 | SpyCas9-SpRY | 3 | 1 |
| 43 | tG | ACTTTGCTGCCACAATACCT | 17075 | SpyCas9-NG | 3 | 1 |
| 44 | tG | ACTTTGCTGCCACAATACCT | 17076 | SpyCas9-xCas | 3 | 1 |
| 45 | tG | ACTTTGCTGCCACAATACCT | 17077 | SpyCas9-xCas-NG | 3 | 1 |
| 46 | tGGCCCTT | ggaaCTTTGCTGCCACAATACCT | 17078 | BlatCas9 | 3 | 1 |
| 47 | tGGCC | ggaaCTTTGCTGCCACAATACCT | 17079 | BlatCas9 | 3 | 1 |
| 48 | tGGCCCT | GAACTTTGCTGCCACAATACCT | 17080 | CdiCas9 | 3 | 1 |
| 49 | tGGC | ACTTTGCTGCCACAATACCT | 17081 | SpyCas9-3var-NRRH | 3 | 1 |
| 50 | TtGGCC | taGGAACTTTGCTGCCACAATACC | 17082 | Nme2Cas9 | 4 | 1 |
| 51 | CaAGG | TCGTAGCGAACTGAGAAGGGC | 17083 | SauCas9KKH | 4 | 1 |
| 52 | CaAGGT | TCGTAGCGAACTGAGAAGGGC | 17084 | SauCas9KKH | 4 | 1 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 53 | CaAGGT | TCGTAGCGAACTGAGAAGGGC | 17085 | cCas9-v17 | 4 | 1 |
| 54 | CaAGGT | TCGTAGCGAACTGAGAAGGGC | 17086 | cCas9-v42 | 4 | 1 |
| 55 | TtGG | GAACTTTGCTGCCACAATACC | 17087 | SauriCas9 | 4 | 1 |
| 56 | TtGG | GAACTTTGCTGCCACAATACC | 17088 | SauriCas9-KKH | 4 | 1 |
| 57 | CaAG | TCGTAGCGAACTGAGAAGGGC | 17089 | SauriCas9-KKH | 4 | 1 |
| 58 | CaAG | CGTAGCGAACTGAGAAGGGC | 17090 | SpyCas9-QQR1 | 4 | 1 |
| 59 | CaAG | tcGTAGCGAACTGAGAAGGGC | 17091 | iSpyMacCas9 | 4 | 1 |
| 60 | TtG | AACTTTGCTGCCACAATACC | 17092 | ScaCas9 | 4 | 1 |
| 61 | TtG | AACTTTGCTGCCACAATACC | 17093 | ScaCas9-HiFi-Sc++ | 4 | 1 |
| 62 | TtG | AACTTTGCTGCCACAATACC | 17094 | ScaCas9-Sc++ | 4 | 1 |
| 63 | TtG | AACTTTGCTGCCACAATACC | 17095 | SpyCas9-SpRY | 4 | 1 |
| 64 | CaA | CGTAGCGAACTGAGAAGGGC | 17096 | SpyCas9-SpRY | 4 | 1 |
| 65 | TtGGC | aggaACTTTGCTGCCACAATACC | 17097 | BlatCas9 | 4 | 1 |
| 66 | CCaAG | GTCGTAGCGAACTGAGAAGGG | 17098 | SauCas9KKH | 5 | 1 |
| 67 | CTtGG | GGAACTTTGCTGCCACAATAC | 17099 | SauCas9KKH | 5 | 1 |
| 68 | CCa | TCGTAGCGAACTGAGAAGGG | 17100 | SpyCas9-SpRY | 5 | 1 |
| 69 | CTt | GAACTTTGCTGCCACAATAC | 17101 | SpyCas9-SpRY | 5 | 1 |
| 70 | CCaAGG | GTCGTAGCGAACTGAGAAGGG | 17102 | cCas9-v17 | 5 | 1 |
| 71 | CCaAGG | GTCGTAGCGAACTGAGAAGGG | 17103 | cCas9-v42 | 5 | 1 |
| 72 | GCCaA | GGTCGTAGCGAACTGAGAAGG | 17104 | SauCas9KKH | 6 | 1 |
| 73 | GCC | GTCGTAGCGAACTGAGAAGG | 17105 | SpyCas9-SpRY | 6 | 0 |
| 74 | CCT | GGAACTTTGCTGCCACAATA | 17106 | SpyCas9-SpRY | 6 | 0 |
| 75 | GCCaAG | GGTCGTAGCGAACTGAGAAGG | 17107 | cCas9-v17 | 6 | 1 |
| 76 | GCCaAG | GGTCGTAGCGAACTGAGAAGG | 17108 | cCas9-v42 | 6 | 1 |
| 77 | GG | GGTCGTAGCGAACTGAGAAG | 17109 | SpyCas9-NG | 7 | 0 |
| 78 | GG | GGTCGTAGCGAACTGAGAAG | 17110 | SpyCas9-xCas | 7 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 79 | GG | GGTCGTAGCGAACTGAGAAG | 17111 | SpyCas9-xCas-NG | 7 | 0 |
| 80 | GGC | GGTCGTAGCGAACTGAGAAG | 17112 | SpyCas9-SpG | 7 | 0 |
| 81 | GGC | GGTCGTAGCGAACTGAGAAG | 17113 | SpyCas9-SpRY | 7 | 0 |
| 82 | ACC | AGGAACTTTGCTGCCACAAT | 17114 | SpyCas9-SpRY | 7 | 0 |
| 83 | GGCC | GGTCGTAGCGAACTGAGAAG | 17115 | SpyCas9-3var-NRCH | 7 | 0 |
| 84 | GGG | GGGTCGTAGCGAACTGAGAA | 17116 | ScaCas9 | 8 | 0 |
| 85 | GGG | GGGTCGTAGCGAACTGAGAA | 17117 | ScaCas9-HiFi-Sc++ | 8 | 0 |
| 86 | GGG | GGGTCGTAGCGAACTGAGAA | 17118 | ScaCas9-Sc++ | 8 | 0 |
| 87 | GGG | GGGTCGTAGCGAACTGAGAA | 17119 | SpyCas9 | 8 | 0 |
| 88 | GGG | GGGTCGTAGCGAACTGAGAA | 17120 | SpyCas9-HF1 | 8 | 0 |
| 89 | GGG | GGGTCGTAGCGAACTGAGAA | 17121 | SpyCas9-SpG | 8 | 0 |
| 90 | GGG | GGGTCGTAGCGAACTGAGAA | 17122 | SpyCas9-SpRY | 8 | 0 |
| 91 | GG | GGGTCGTAGCGAACTGAGAA | 17123 | SpyCas9-NG | 8 | 0 |
| 92 | GG | GGGTCGTAGCGAACTGAGAA | 17124 | SpyCas9-xCas | 8 | 0 |
| 93 | GG | GGGTCGTAGCGAACTGAGAA | 17125 | SpyCas9-xCas-NG | 8 | 0 |
| 94 | TAC | TAGGAACTTTGCTGCCACAA | 17126 | SpyCas9-SpRY | 8 | 0 |
| 95 | GGGCCaAG | tatgGGTCGTAGCGAACTGAGAA | 17127 | BlatCas9 | 8 | 1 |
| 96 | GGGCC | tatgGGTCGTAGCGAACTGAGAA | 17128 | BlatCas9 | 8 | 0 |
| 97 | GGGC | GGGTCGTAGCGAACTGAGAA | 17129 | SpyCas9-3var-NRRH | 8 | 0 |
| 98 | TACC | TAGGAACTTTGCTGCCACAA | 17130 | SpyCas9-3var-NRCH | 8 | 0 |
| 99 | AGGGCC | tgTATGGGTCGTAGCGAACTGAGA | 17131 | Nme2Cas9 | 9 | 0 |
| 100 | AGGG | ATGGGTCGTAGCGAACTGAGA | 17132 | SauriCas9 | 9 | 0 |
| 101 | AGGG | ATGGGTCGTAGCGAACTGAGA | 17133 | SauriCas9-KKH | 9 | 0 |
| 102 | AGG | TGGGTCGTAGCGAACTGAGA | 17134 | ScaCas9 | 9 | 0 |
| 103 | AGG | TGGGTCGTAGCGAACTGAGA | 17135 | ScaCas9-HiFi-Sc++ | 9 | 0 |
| 104 | AGG | TGGGTCGTAGCGAACTGAGA | 17136 | ScaCas9-Sc++ | 9 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 105 | AGG | TGGGTCGTAGCGAACTGAGA | 17137 | SpyCas9 | 9 | 0 |
| 106 | AGG | TGGGTCGTAGCGAACTGAGA | 17138 | SpyCas9-HF1 | 9 | 0 |
| 107 | AGG | TGGGTCGTAGCGAACTGAGA | 17139 | SpyCas9-SpG | 9 | 0 |
| 108 | AGG | TGGGTCGTAGCGAACTGAGA | 17140 | SpyCas9-SpRY | 9 | 0 |
| 109 | AG | TGGGTCGTAGCGAACTGAGA | 17141 | SpyCas9-NG | 9 | 0 |
| 110 | AG | TGGGTCGTAGCGAACTGAGA | 17142 | SpyCas9-xCas | 9 | 0 |
| 111 | AG | TGGGTCGTAGCGAACTGAGA | 17143 | SpyCas9-xCas-NG | 9 | 0 |
| 112 | ATA | TTAGGAACTTTGCTGCCACA | 17144 | SpyCas9-SpRY | 9 | 0 |
| 113 | AGGGCCaA | gtatGGGTCGTAGCGAACTGAGA | 17145 | BlatCas9 | 9 | 1 |
| 114 | AGGGCCaA | gtatGGGTCGTAGCGAACTGAGA | 17146 | BlatCas9 | 9 | 1 |
| 115 | ATACCTtG | gtctTAGGAACTTTGCTGCCACA | 17147 | BlatCas9 | 9 | 1 |
| 116 | AGGGC | gtatGGGTCGTAGCGAACTGAGA | 17148 | BlatCas9 | 9 | 0 |
| 117 | ATACC | gtctTAGGAACTTTGCTGCCACA | 17149 | BlatCas9 | 9 | 0 |
| 118 | ATACCTt | TCTTAGGAACTTTGCTGCCACA | 17150 | CdiCas9 | 9 | 1 |
| 119 | AATACC | tgGTCTTAGGAACTTTGCTGCCAC | 17151 | Nme2Cas9 | 10 | 0 |
| 120 | AAGGG | tgTATGGGTCGTAGCGAACTGAG | 17152 | SauCas9 | 10 | 0 |
| 121 | AAGGG | TATGGGTCGTAGCGAACTGAG | 17153 | SauCas9KKH | 10 | 0 |
| 122 | AAGG | TATGGGTCGTAGCGAACTGAG | 17154 | SauriCas9 | 10 | 0 |
| 123 | AAGG | TATGGGTCGTAGCGAACTGAG | 17155 | SauriCas9-KKH | 10 | 0 |
| 124 | AAG | ATGGGTCGTAGCGAACTGAG | 17156 | ScaCas9 | 10 | 0 |
| 125 | AAG | ATGGGTCGTAGCGAACTGAG | 17157 | ScaCas9-HiFi-Sc++ | 10 | 0 |
| 126 | AAG | ATGGGTCGTAGCGAACTGAG | 17158 | ScaCas9-Sc++ | 10 | 0 |
| 127 | AAG | ATGGGTCGTAGCGAACTGAG | 17159 | SpyCas9-SpRY | 10 | 0 |
| 128 | AAT | CTTAGGAACTTTGCTGCCAC | 17160 | SpyCas9-SpRY | 10 | 0 |
| 129 | AATACCTt | ggtcTTAGGAACTTTGCTGCCAC | 17161 | BlatCas9 | 10 | 1 |
| 130 | AATAC | ggtcTTAGGAACTTTGCTGCCAC | 17162 | BlatCas9 | 10 | 0 |
| 131 | AAGGGC | TATGGGTCGTAGCGAACTGAG | 17163 | cCas9-v17 | 10 | 0 |
| 132 | AAGGGC | TATGGGTCGTAGCGAACTGAG | 17164 | cCas9-v42 | 10 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 133 | AATA | CTTAGGAACTTTGCTGCCAC | 17165 | SpyCas9-3var-NRTH | 10 | 0 |
| 134 | GAAGG | GTATGGGTCGTAGCGAACTGA | 17166 | SauCas9KKH | 11 | 0 |
| 135 | GAAG | GTATGGGTCGTAGCGAACTGA | 17167 | SauriCas9-KKH | 11 | 0 |
| 136 | GAAG | TATGGGTCGTAGCGAACTGA | 17168 | SpyCas9-QQR1 | 11 | 0 |
| 137 | GAAG | gtATGGGTCGTAGCGAACTGA | 17169 | iSpy MacCas9 | 11 | 0 |
| 138 | GAA | TATGGGTCGTAGCGAACTGA | 17170 | SpyCas9-SpRY | 11 | 0 |
| 139 | GAA | TATGGGTCGTAGCGAACTGA | 17171 | SpyCas9-xCas | 11 | 0 |
| 140 | CAA | TCTTAGGAACTTTGCTGCCA | 17172 | SpyCas9-SpRY | 11 | 0 |
| 141 | GAAGGG | GTATGGGTCGTAGCGAACTGA | 17173 | cCas9-v17 | 11 | 0 |
| 142 | GAAGGG | GTATGGGTCGTAGCGAACTGA | 17174 | cCas9-v42 | 11 | 0 |
| 143 | CAATACC | GGTCTTAGGAACTTTGCTGCCA | 17175 | CdiCas9 | 11 | 0 |
| 144 | CAAT | TCTTAGGAACTTTGCTGCCA | 17176 | SpyCas9-3var-NRRH | 11 | 0 |
| 145 | CAAT | gtCTTAGGAACTTTGCTGCCA | 17177 | iSpyMacCas9 | 11 | 0 |
| 146 | AGAAG | TGTATGGGTCGTAGCGAACTG | 17178 | SauCas9KKH | 12 | 0 |
| 147 | AG | GTATGGGTCGTAGCGAACTG | 17179 | SpyCas9-NG | 12 | 0 |
| 148 | AG | GTATGGGTCGTAGCGAACTG | 17180 | SpyCas9-xCas | 12 | 0 |
| 149 | AG | GTATGGGTCGTAGCGAACTG | 17181 | SpyCas9-xCas-NG | 12 | 0 |
| 150 | AGA | GTATGGGTCGTAGCGAACTG | 17182 | SpyCas9-SpG | 12 | 0 |
| 151 | AGA | GTATGGGTCGTAGCGAACTG | 17183 | SpyCas9-SpRY | 12 | 0 |
| 152 | ACA | GTCTTAGGAACTTTGCTGCC | 17184 | SpyCas9-SpRY | 12 | 0 |
| 153 | AGAAGG | TGTATGGGTCGTAGCGAACTG | 17185 | cCas9-v17 | 12 | 0 |
| 154 | AGAAGG | TGTATGGGTCGTAGCGAACTG | 17186 | cCas9-v42 | 12 | 0 |
| 155 | ACAATAC | TGGTCTTAGGAACTTTGCTGCC | 17187 | CdiCas9 | 12 | 0 |
| 156 | AGAA | GTATGGGTCGTAGCGAACTG | 17188 | SpyCas9-3var-NRRH | 12 | 0 |
| 157 | AGAA | GTATGGGTCGTAGCGAACTG | 17189 | SpyCas9-VQR | 12 | 0 |
| 158 | GAGAA | ggGTGTATGGGTCGTAGCGAACT | 17190 | SauCas9 | 13 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 159 | GAGAA | GTGTATGGGTCGTAGCGAACT | 17191 | SauCas9KKH | 13 | 0 |
| 160 | CACAA | TGGTCTTAGGAACTTTGCTGC | 17192 | SauCas9KKH | 13 | 0 |
| 161 | CACAAT | TGGTCTTAGGAACTTTGCTGC | 17193 | SauCas9KKH | 13 | 0 |
| 162 | CACAAT | TGGTCTTAGGAACTTTGCTGC | 17194 | cCas9-v17 | 13 | 0 |
| 163 | CACAAT | TGGTCTTAGGAACTTTGCTGC | 17195 | cCas9-v42 | 13 | 0 |
| 164 | GAG | TGTATGGGTCGTAGCGAACT | 17196 | ScaCas9 | 13 | 0 |
| 165 | GAG | TGTATGGGTCGTAGCGAACT | 17197 | ScaCas9-HiFi-Sc++ | 13 | 0 |
| 166 | GAG | TGTATGGGTCGTAGCGAACT | 17198 | ScaCas9-Sc++ | 13 | 0 |
| 167 | GAG | TGTATGGGTCGTAGCGAACT | 17199 | SpyCas9-SpRY | 13 | 0 |
| 168 | CAC | GGTCTTAGGAACTTTGCTGC | 17200 | SpyCas9-SpRY | 13 | 0 |
| 169 | GAGAAG | GTGTATGGGTCGTAGCGAACT | 17201 | cCas9-v17 | 13 | 0 |
| 170 | GAGAAG | GTGTATGGGTCGTAGCGAACT | 17202 | cCas9-v42 | 13 | 0 |
| 171 | CACAATAC | ttTGGTCTTAGGAACTTTGCTGC | 17203 | CjeCas9 | 13 | 0 |
| 172 | GAGA | TGTATGGGTCGTAGCGAACT | 17204 | SpyCas9-3var-NRRH | 13 | 0 |
| 173 | CACA | GGTCTTAGGAACTTTGCTGC | 17205 | SpyCas9-3var-NRCH | 13 | 0 |
| 174 | TGAGA | GGTGTATGGGTCGTAGCGAAC | 17206 | SauCas9KKH | 14 | 0 |
| 175 | TGAG | GGTGTATGGGTCGTAGCGAAC | 17207 | SauriCas9-KKH | 14 | 0 |
| 176 | TGAG | GTGTATGGGTCGTAGCGAAC | 17208 | SpyCas9-VQR | 14 | 0 |
| 177 | TG | GTGTATGGGTCGTAGCGAAC | 17209 | SpyCas9-NG | 14 | 0 |
| 178 | TG | GTGTATGGGTCGTAGCGAAC | 17210 | SpyCas9-xCas | 14 | 0 |
| 179 | TG | GTGTATGGGTCGTAGCGAAC | 17211 | SpyCas9-xCas-NG | 14 | 0 |
| 180 | TGA | GTGTATGGGTCGTAGCGAAC | 17212 | SpyCas9-SpG | 14 | 0 |
| 181 | TGA | GTGTATGGGTCGTAGCGAAC | 17213 | SpyCas9-SpRY | 14 | 0 |
| 182 | CCA | TGGTCTTAGGAACTTTGCTG | 17214 | SpyCas9-SpRY | 14 | 0 |
| 183 | TGAGAA | GGTGTATGGGTCGTAGCGAAC | 17215 | cCas9-v17 | 14 | 0 |
| 184 | TGAGAA | GGTGTATGGGTCGTAGCGAAC | 17216 | cCas9-v42 | 14 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 185 | CCACAAT | TTTGGTCTTAGGAACTTTGCTG | 17217 | CdiCas9 | 14 | 0 |
| 186 | CCACAA | TGGTCTTAGGAACTTTGCTG | 17218 | St1Cas9-CNRZ1066 | 14 | 0 |
| 187 | CTGAG | ttGGGTGTATGGGTCGTAGCGAA | 17219 | SauCas9 | 15 | 0 |
| 188 | CTGAG | GGGTGTATGGGTCGTAGCGAA | 17220 | SauCas9KKH | 15 | 0 |
| 189 | CTG | GGTGTATGGGTCGTAGCGAA | 17221 | ScaCas9 | 15 | 0 |
| 190 | CTG | GGTGTATGGGTCGTAGCGAA | 17222 | ScaCas9-HiFi-Sc++ | 15 | 0 |
| 191 | CTG | GGTGTATGGGTCGTAGCGAA | 17223 | ScaCas9-Sc++ | 15 | 0 |
| 192 | CTG | GGTGTATGGGTCGTAGCGAA | 17224 | SpyCas9-SpRY | 15 | 0 |
| 193 | GCC | TTGGTCTTAGGAACTTTGCT | 17225 | SpyCas9-SpRY | 15 | 0 |
| 194 | GCCACAAT | gtttTGGTCTTAGGAACTTTGCT | 17226 | BlatCas9 | 15 | 0 |
| 195 | GCCAC | gtttTGGTCTTAGGAACTTTGCT | 17227 | BlatCas9 | 15 | 0 |
| 196 | CTGAGA | GGGTGTATGGGTCGTAGCGAA | 17228 | cCas9-v17 | 15 | 0 |
| 197 | CTGAGA | GGGTGTATGGGTCGTAGCGAA | 17229 | cCas9-v42 | 15 | 0 |
| 198 | ACTGA | TGGGTGTATGGGTCGTAGCGA | 17230 | SauCas9KKH | 16 | 0 |
| 199 | TG | TTTGGTCTTAGGAACTTTGC | 17231 | SpyCas9-NG | 16 | 0 |
| 200 | TG | TTTGGTCTTAGGAACTTTGC | 17232 | SpyCas9-xCas | 16 | 0 |
| 201 | TG | TTTGGTCTTAGGAACTTTGC | 17233 | SpyCas9-xCas-NG | 16 | 0 |
| 202 | TGC | TTTGGTCTTAGGAACTTTGC | 17234 | SpyCas9-SpG | 16 | 0 |
| 203 | TGC | TTTGGTCTTAGGAACTTTGC | 17235 | SpyCas9-SpRY | 16 | 0 |
| 204 | ACT | GGGTGTATGGGTCGTAGCGA | 17236 | SpyCas9-SpRY | 16 | 0 |
| 205 | TGCC | TTTGGTCTTAGGAACTTTGC | 17237 | SpyCas9-3var-NRCH | 16 | 0 |
| 206 | CTG | TTTTGGTCTTAGGAACTTTG | 17238 | ScaCas9 | 17 | 0 |
| 207 | CTG | TTTTGGTCTTAGGAACTTTG | 17239 | ScaCas9-HiFi-Sc++ | 17 | 0 |
| 208 | CTG | TTTTGGTCTTAGGAACTTTG | 17240 | ScaCas9-Sc++ | 17 | 0 |
| 209 | CTG | TTTTGGTCTTAGGAACTTTG | 17241 | SpyCas9-SpRY | 17 | 0 |
| 210 | AAC | TGGGTGTATGGGTCGTAGCG | 17242 | SpyCas9-SpRY | 17 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 211 | CTGCC | tggtTTTGGTCTTAGGAACTTTG | 17243 | BlatCas9 | 17 | 0 |
| 212 | CTGCCAC | GGTTTTGGTCTTAGGAACTTTG | 17244 | CdiCas9 | 17 | 0 |
| 213 | AACT | TGGGTGTATGGGTCGTAGCG | 17245 | SpyCas9-3var-NRCH | 17 | 0 |
| 214 | GCTGCC | tgTGGTTTTGGTCTTAGGAACTTT | 17246 | Nme2Cas9 | 18 | 0 |
| 215 | GAA | TTGGGTGTATGGGTCGTAGC | 17247 | SpyCas9-SpRY | 18 | 0 |
| 216 | GAA | TTGGGTGTATGGGTCGTAGC | 17248 | SpyCas9-xCas | 18 | 0 |
| 217 | GCT | GTTTTGGTCTTAGGAACTTT | 17249 | SpyCas9-SpRY | 18 | 0 |
| 218 | GCTGC | gtggTTTTGGTCTTAGGAACTTT | 17250 | BlatCas9 | 18 | 0 |
| 219 | GAAC | TTGGGTGTATGGGTCGTAGC | 17251 | SpyCas9-3var-NRRH | 18 | 0 |
| 220 | GAAC | ttTGGGTGTATGGGTCGTAGC | 17252 | iSpyMacCas9 | 18 | 0 |
| 221 | CG | TTTGGGTGTATGGGTCGTAG | 17253 | SpyCas9-NG | 19 | 0 |
| 222 | CG | TTTGGGTGTATGGGTCGTAG | 17254 | SpyCas9-xCas | 19 | 0 |
| 223 | CG | TTTGGGTGTATGGGTCGTAG | 17255 | SpyCas9-xCas-NG | 19 | 0 |
| 224 | TG | GGTTTTGGTCTTAGGAACTT | 17256 | SpyCas9-NG | 19 | 0 |
| 225 | TG | GGTTTTGGTCTTAGGAACTT | 17257 | SpyCas9-xCas | 19 | 0 |
| 226 | TG | GGTTTTGGTCTTAGGAACTT | 17258 | SpyCas9-xCas-NG | 19 | 0 |
| 227 | CGA | TTTGGGTGTATGGGTCGTAG | 17259 | SpyCas9-SpG | 19 | 0 |
| 228 | CGA | TTTGGGTGTATGGGTCGTAG | 17260 | SpyCas9-SpRY | 19 | 0 |
| 229 | TGC | GGTTTTGGTCTTAGGAACTT | 17261 | SpyCas9-SpG | 19 | 0 |
| 230 | TGC | GGTTTTGGTCTTAGGAACTT | 17262 | SpyCas9-SpRY | 19 | 0 |
| 231 | CGAACTGA | tcctTTGGGTGTATGGGTCGTAG | 17263 | BlatCas9 | 19 | 0 |
| 232 | CGAAC | tcctTTGGGTGTATGGGTCGTAG | 17264 | BlatCas9 | 19 | 0 |
| 233 | CGAACT | CTTTGGGTGTATGGGTCGTAG | 17265 | cCas9-v16 | 19 | 0 |
| 234 | CGAACT | CTTTGGGTGTATGGGTCGTAG | 17266 | cCas9-v21 | 19 | 0 |
| 235 | CGAA | TTTGGGTGTATGGGTCGTAG | 17267 | SpyCas9-3var-NRRH | 19 | 0 |
| 236 | CGAA | TTTGGGTGTATGGGTCGTAG | 17268 | SpyCas9-VQR | 19 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 237 | TGCT | GGTTTTGGTCTTAGGAACTT | 17269 | SpyCas9-3var-NRCH | 19 | 0 |
| 238 | GCGAA | atCCTTTGGGTGTATGGGTCGTA | 17270 | SauCas9 | 20 | 0 |
| 239 | GCGAA | CCTTTGGGTGTATGGGTCGTA | 17271 | SauCas9KKH | 20 | 0 |
| 240 | GCG | CTTTGGGTGTATGGGTCGTA | 17272 | ScaCas9 | 20 | 0 |
| 241 | GCG | CTTTGGGTGTATGGGTCGTA | 17273 | ScaCas9-HiFi-Sc++ | 20 | 0 |
| 242 | GCG | CTTTGGGTGTATGGGTCGTA | 17274 | ScaCas9-Sc++ | 20 | 0 |
| 243 | GCG | CTTTGGGTGTATGGGTCGTA | 17275 | SpyCas9-SpRY | 20 | 0 |
| 244 | TTG | TGGTTTTGGTCTTAGGAACT | 17276 | ScaCas9 | 20 | 0 |
| 245 | TTG | TGGTTTTGGTCTTAGGAACT | 17277 | ScaCas9-HiFi-Sc++ | 20 | 0 |
| 246 | TTG | TGGTTTTGGTCTTAGGAACT | 17278 | ScaCas9-Sc++ | 20 | 0 |
| 247 | TTG | TGGTTTTGGTCTTAGGAACT | 17279 | SpyCas9-SpRY | 20 | 0 |
| 248 | GCGAAC | CCTTTGGGTGTATGGGTCGTA | 17280 | cCas9-v17 | 20 | 0 |
| 249 | GCGAAC | CCTTTGGGTGTATGGGTCGTA | 17281 | cCas9-v42 | 20 | 0 |
| 250 | GCGAACT | TCCTTTGGGTGTATGGGTCGTA | 17282 | CdiCas9 | 20 | 0 |
| 251 | AGCGA | TCCTTTGGGTGTATGGGTCGT | 17283 | SauCas9KKH | 21 | 0 |
| 252 | AG | CCTTTGGGTGTATGGGTCGT | 17284 | SpyCas9-NG | 21 | 0 |
| 253 | AG | CCTTTGGGTGTATGGGTCGT | 17285 | SpyCas9-xCas | 21 | 0 |
| 254 | AG | CCTTTGGGTGTATGGGTCGT | 17286 | SpyCas9-xCas-NG | 21 | 0 |
| 255 | AGC | CCTTTGGGTGTATGGGTCGT | 17287 | SpyCas9-SpG | 21 | 0 |
| 256 | AGC | CCTTTGGGTGTATGGGTCGT | 17288 | SpyCas9-SpRY | 21 | 0 |
| 257 | TTT | GTGGTTTTGGTCTTAGGAAC | 17289 | SpyCas9-SpRY | 21 | 0 |
| 258 | TTTGC | cctgTGGTTTTGGTCTTAGGAAC | 17290 | BlatCas9 | 21 | 0 |
| 259 | AGCGAA | TCCTTTGGGTGTATGGGTCGT | 17291 | cCas9-v17 | 21 | 0 |
| 260 | AGCGAA | TCCTTTGGGTGTATGGGTCGT | 17292 | cCas9-v42 | 21 | 0 |
| 261 | AGCG | CCTTTGGGTGTATGGGTCGT | 17293 | SpyCas9-VRER | 21 | 0 |
| 262 | TAG | TCCTTTGGGTGTATGGGTCG | 17294 | ScaCas9 | 22 | 0 |
| 263 | TAG | TCCTTTGGGTGTATGGGTCG | 17295 | ScaCas9-HiFi-Sc++ | 22 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 264 | TAG | TCCTTTGGGTGTATGGGTCG | 17296 | ScaCas9-Sc++ | 22 | 0 |
| 265 | TAG | TCCTTTGGGTGTATGGGTCG | 17297 | SpyCas9-SpRY | 22 | 0 |
| 266 | CTT | TGTGGTTTTGGTCTTAGGAA | 17298 | SpyCas9-SpRY | 22 | 0 |
| 267 | TAGC | TCCTTTGGGTGTATGGGTCG | 17299 | SpyCas9-3var-NRRH | 22 | 0 |
| 268 | GTAG | AATCCTTTGGGTGTATGGGTC | 17300 | SauriCas9-KKH | 23 | 0 |
| 269 | GTA | ATCCTTTGGGTGTATGGGTC | 17301 | SpyCas9-SpRY | 23 | 0 |
| 270 | ACT | CTGTGGTTTTGGTCTTAGGA | 17302 | SpyCas9-SpRY | 23 | 0 |
| 271 | GTAGCGAA | tcaaTCCTTTGGGTGTATGGGTC | 17303 | BlatCas9 | 23 | 0 |
| 272 | GTAGCGAA | tcaaTCCTTTGGGTGTATGGGTC | 17304 | BlatCas9 | 23 | 0 |
| 273 | GTAGCGAA | tcAATCCTTTGGGTGTATGGGTC | 17305 | GeoCas9 | 23 | 0 |
| 274 | GTAGC | tcaaTCCTTTGGGTGTATGGGTC | 17306 | BlatCas9 | 23 | 0 |
| 275 | CGTAG | CAATCCTTTGGGTGTATGGGT | 17307 | SauCas9KKH | 24 | 0 |
| 276 | CG | AATCCTTTGGGTGTATGGGT | 17308 | SpyCas9-NG | 24 | 0 |
| 277 | CG | AATCCTTTGGGTGTATGGGT | 17309 | SpyCas9-xCas | 24 | 0 |
| 278 | CG | AATCCTTTGGGTGTATGGGT | 17310 | SpyCas9-xCas-NG | 24 | 0 |
| 279 | CGT | AATCCTTTGGGTGTATGGGT | 17311 | SpyCas9-SpG | 24 | 0 |
| 280 | CGT | AATCCTTTGGGTGTATGGGT | 17312 | SpyCas9-SpRY | 24 | 0 |
| 281 | AAC | CCTGTGGTTTTGGTCTTAGG | 17313 | SpyCas9-SpRY | 24 | 0 |
| 282 | CGTA | AATCCTTTGGGTGTATGGGT | 17314 | SpyCas9-3var-NRTH | 24 | 0 |
| 283 | AACT | CCTGTGGTTTTGGTCTTAGG | 17315 | SpyCas9-3var-NRCH | 24 | 0 |
| 284 | TCG | CAATCCTTTGGGTGTATGGG | 17316 | ScaCas9 | 25 | 0 |
| 285 | TCG | CAATCCTTTGGGTGTATGGG | 17317 | ScaCas9-HiFi-Sc++ | 25 | 0 |
| 286 | TCG | CAATCCTTTGGGTGTATGGG | 17318 | ScaCas9-Sc++ | 25 | 0 |
| 287 | TCG | CAATCCTTTGGGTGTATGGG | 17319 | SpyCas9-SpRY | 25 | 0 |
| 288 | GAA | GCCTGTGGTTTTGGTCTTAG | 17320 | SpyCas9-SpRY | 25 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 289 | GAA | GCCTGTGGTTTTGGTCTTAG | 17321 | SpyCas9-xCas | 25 | 0 |
| 290 | GAACTTT | AAGCCTGTGGTTTTGGTCTTAG | 17322 | CdiCas9 | 25 | 0 |
| 291 | GAAC | GCCTGTGGTTTTGGTCTTAG | 17323 | SpyCas9-3var-NRRH | 25 | 0 |
| 292 | GAAC | agCCTGTGGTTTTGGTCTTAG | 17324 | iSpyMacCas9 | 25 | 0 |
| 293 | GG | AGCCTGTGGTTTTGGTCTTA | 17325 | SpyCas9-NG | 26 | 0 |
| 294 | GG | AGCCTGTGGTTTTGGTCTTA | 17326 | SpyCas9-xCas | 26 | 0 |
| 295 | GG | AGCCTGTGGTTTTGGTCTTA | 17327 | SpyCas9-xCas-NG | 26 | 0 |
| 296 | GGA | AGCCTGTGGTTTTGGTCTTA | 17328 | SpyCas9-SpG | 26 | 0 |
| 297 | GGA | AGCCTGTGGTTTTGGTCTTA | 17329 | SpyCas9-SpRY | 26 | 0 |
| 298 | GTC | TCAATCCTTTGGGTGTATGG | 17330 | SpyCas9-SpRY | 26 | 0 |
| 299 | GGAACTTT | tcaaGCCTGTGGTTTTGGTCTTA | 17331 | BlatCas9 | 26 | 0 |
| 300 | GGAAC | tcaaGCCTGTGGTTTTGGTCTTA | 17332 | BlatCas9 | 26 | 0 |
| 301 | GGAACT | AAGCCTGTGGTTTTGGTCTTA | 17333 | cCas9-v16 | 26 | 0 |
| 302 | GGAACT | AAGCCTGTGGTTTTGGTCTTA | 17334 | cCas9-v21 | 26 | 0 |
| 303 | GGAACTT | CAAGCCTGTGGTTTTGGTCTTA | 17335 | CdiCas9 | 26 | 0 |
| 304 | GGAA | AGCCTGTGGTTTTGGTCTTA | 17336 | SpyCas9-3var-NRRH | 26 | 0 |
| 305 | GGAA | AGCCTGTGGTTTTGGTCTTA | 17337 | SpyCas9-VQR | 26 | 0 |
| 306 | AGGAA | ctCAAGCCTGTGGTTTTGGTCTT | 17338 | SauCas9 | 27 | 0 |
| 307 | AGGAA | CAAGCCTGTGGTTTTGGTCTT | 17339 | SauCas9KKH | 27 | 0 |
| 308 | AGG | AAGCCTGTGGTTTTGGTCTT | 17340 | ScaCas9 | 27 | 0 |
| 309 | AGG | AAGCCTGTGGTTTTGGTCTT | 17341 | ScaCas9-HiFi-Sc++ | 27 | 0 |
| 310 | AGG | AAGCCTGTGGTTTTGGTCTT | 17342 | ScaCas9-Sc++ | 27 | 0 |
| 311 | AGG | AAGCCTGTGGTTTTGGTCTT | 17343 | SpyCas9 | 27 | 0 |
| 312 | AGG | AAGCCTGTGGTTTTGGTCTT | 17344 | SpyCas9-HF1 | 27 | 0 |
| 313 | AGG | AAGCCTGTGGTTTTGGTCTT | 17345 | SpyCas9-SpG | 27 | 0 |
| 314 | AGG | AAGCCTGTGGTTTTGGTCTT | 17346 | SpyCas9-SpRY | 27 | 0 |
| 315 | GG | CTCAATCCTTTGGGTGTATG | 17347 | SpyCas9-NG | 27 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 316 | GG | CTCAATCCTTTGGGTGTATG | 17348 | SpyCas9-xCas | 27 | 0 |
| 317 | GG | CTCAATCCTTTGGGTGTATG | 17349 | SpyCas9-xCas-NG | 27 | 0 |
| 318 | AG | AAGCCTGTGGTTTTGGTCTT | 17350 | SpyCas9-NG | 27 | 0 |
| 319 | AG | AAGCCTGTGGTTTTGGTCTT | 17351 | SpyCas9-xCas | 27 | 0 |
| 320 | AG | AAGCCTGTGGTTTTGGTCTT | 17352 | SpyCas9-xCas-NG | 27 | 0 |
| 321 | GGT | CTCAATCCTTTGGGTGTATG | 17353 | SpyCas9-SpG | 27 | 0 |
| 322 | GGT | CTCAATCCTTTGGGTGTATG | 17354 | SpyCas9-SpRY | 27 | 0 |
| 323 | AGGAAC | CAAGCCTGTGGTTTTGGTCTT | 17355 | cCas9-v17 | 27 | 0 |
| 324 | AGGAAC | CAAGCCTGTGGTTTTGGTCTT | 17356 | cCas9-v42 | 27 | 0 |
| 325 | AGGAACT | TCAAGCCTGTGGTTTTGGTCTT | 17357 | CdiCas9 | 27 | 0 |
| 326 | AGGA | AAGCCTGTGGTTTTGGTCTT | 17358 | SpyCas9-3var-NRRH | 27 | 0 |
| 327 | GGTC | CTCAATCCTTTGGGTGTATG | 17359 | SpyCas9-3var-NRTH | 27 | 0 |
| 328 | TAGGA | acTCAAGCCTGTGGTTTTGGTCT | 17360 | SauCas9 | 28 | 0 |
| 329 | TAGGA | TCAAGCCTGTGGTTTTGGTCT | 17361 | SauCas9KKH | 28 | 0 |
| 330 | TAGG | TCAAGCCTGTGGTTTTGGTCT | 17362 | SauriCas9 | 28 | 0 |
| 331 | TAGG | TCAAGCCTGTGGTTTTGGTCT | 17363 | SauriCas9-KKH | 28 | 0 |
| 332 | GGG | CCTCAATCCTTTGGGTGTAT | 17364 | ScaCas9 | 28 | 0 |
| 333 | GGG | CCTCAATCCTTTGGGTGTAT | 17365 | ScaCas9-HiFi-Sc++ | 28 | 0 |
| 334 | GGG | CCTCAATCCTTTGGGTGTAT | 17366 | ScaCas9-Sc++ | 28 | 0 |
| 335 | GGG | CCTCAATCCTTTGGGTGTAT | 17367 | SpyCas9 | 28 | 0 |
| 336 | GGG | CCTCAATCCTTTGGGTGTAT | 17368 | SpyCas9-HF1 | 28 | 0 |
| 337 | GGG | CCTCAATCCTTTGGGTGTAT | 17369 | SpyCas9-SpG | 28 | 0 |
| 338 | GGG | CCTCAATCCTTTGGGTGTAT | 17370 | SpyCas9-SpRY | 28 | 0 |
| 339 | TAG | CAAGCCTGTGGTTTTGGTCT | 17371 | ScaCas9 | 28 | 0 |
| 340 | TAG | CAAGCCTGTGGTTTTGGTCT | 17372 | ScaCas9-HiFi-Sc++ | 28 | 0 |
| 341 | TAG | CAAGCCTGTGGTTTTGGTCT | 17373 | ScaCas9-Sc++ | 28 | 0 |
| 342 | TAG | CAAGCCTGTGGTTTTGGTCT | 17374 | SpyCas9-SpRY | 28 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 343 | GG | CCTCAATCCTTTGGGTGTAT | 17375 | SpyCas9-NG | 28 | 0 |
| 344 | GG | CCTCAATCCTTTGGGTGTAT | 17376 | SpyCas9-xCas | 28 | 0 |
| 345 | GG | CCTCAATCCTTTGGGTGTAT | 17377 | SpyCas9-xCas-NG | 28 | 0 |
| 346 | GGGTCGTA | agacCTCAATCCTTTGGGTGTAT | 17378 | BlatCas9 | 28 | 0 |
| 347 | GGGTC | agacCTCAATCCTTTGGGTGTAT | 17379 | BlatCas9 | 28 | 0 |
| 348 | TAGGAA | TCAAGCCTGTGGTTTTGGTCT | 17380 | cCas9-v17 | 28 | 0 |
| 349 | TAGGAA | TCAAGCCTGTGGTTTTGGTCT | 17381 | cCas9-v42 | 28 | 0 |
| 350 | GGGT | CCTCAATCCTTTGGGTGTAT | 17382 | SpyCas9-3var-NRRH | 28 | 0 |
| 351 | TTAGG | CTCAAGCCTGTGGTTTTGGTC | 17383 | SauCas9KKH | 29 | 0 |
| 352 | TGGG | GACCTCAATCCTTTGGGTGTA | 17384 | SauriCas9 | 29 | 0 |
| 353 | TGGG | GACCTCAATCCTTTGGGTGTA | 17385 | SauriCas9-KKH | 29 | 0 |
| 354 | TTAG | CTCAAGCCTGTGGTTTTGGTC | 17386 | SauriCas9-KKH | 29 | 0 |
| 355 | TGG | ACCTCAATCCTTTGGGTGTA | 17387 | ScaCas9 | 29 | 0 |
| 356 | TGG | ACCTCAATCCTTTGGGTGTA | 17388 | ScaCas9-HiFi-Sc++ | 29 | 0 |
| 357 | TGG | ACCTCAATCCTTTGGGTGTA | 17389 | ScaCas9-Sc++ | 29 | 0 |
| 358 | TGG | ACCTCAATCCTTTGGGTGTA | 17390 | SpyCas9 | 29 | 0 |
| 359 | TGG | ACCTCAATCCTTTGGGTGTA | 17391 | SpyCas9-HF1 | 29 | 0 |
| 360 | TGG | ACCTCAATCCTTTGGGTGTA | 17392 | SpyCas9-SpG | 29 | 0 |
| 361 | TGG | ACCTCAATCCTTTGGGTGTA | 17393 | SpyCas9-SpRY | 29 | 0 |
| 362 | TG | ACCTCAATCCTTTGGGTGTA | 17394 | SpyCas9-NG | 29 | 0 |
| 363 | TG | ACCTCAATCCTTTGGGTGTA | 17395 | SpyCas9-xCas | 29 | 0 |
| 364 | TG | ACCTCAATCCTTTGGGTGTA | 17396 | SpyCas9-xCas-NG | 29 | 0 |
| 365 | TTA | TCAAGCCTGTGGTTTTGGTC | 17397 | SpyCas9-SpRY | 29 | 0 |
| 366 | TTAGGAA | TCAAGCCTGTGGTTTTGGTC | 17398 | St1Cas9 | 29 | 0 |
| 367 | TTAGGA | CTCAAGCCTGTGGTTTTGGTC | 17399 | cCas9-v17 | 29 | 0 |
| 368 | TTAGGA | CTCAAGCCTGTGGTTTTGGTC | 17400 | cCas9-v42 | 29 | 0 |
| 369 | ATGGG | caAGACCTCAATCCTTTGGGTGT | 17401 | SauCas9 | 30 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 370 | ATGGG | AGACCTCAATCCTTTGGGTGT | 17402 | SauCas9KKH | 30 | 0 |
| 371 | ATGGGT | caAGACCTCAATCCTTTGGGTGT | 17403 | SauCas9 | 30 | 0 |
| 372 | ATGGGT | AGACCTCAATCCTTTGGGTGT | 17404 | SauCas9KKH | 30 | 0 |
| 373 | ATGGGT | AGACCTCAATCCTTTGGGTGT | 17405 | cCas9-v17 | 30 | 0 |
| 374 | ATGGGT | AGACCTCAATCCTTTGGGTGT | 17406 | cCas9-v42 | 30 | 0 |
| 375 | CTTAG | ACTCAAGCCTGTGGTTTTGGT | 17407 | SauCas9KKH | 30 | 0 |
| 376 | ATGG | AGACCTCAATCCTTTGGGTGT | 17408 | SauriCas9 | 30 | 0 |
| 377 | ATGG | AGACCTCAATCCTTTGGGTGT | 17409 | SauriCas9-KKH | 30 | 0 |
| 378 | ATG | GACCTCAATCCTTTGGGTGT | 17410 | ScaCas9 | 30 | 0 |
| 379 | ATG | GACCTCAATCCTTTGGGTGT | 17411 | ScaCas9-HiFi-Sc++ | 30 | 0 |
| 380 | ATG | GACCTCAATCCTTTGGGTGT | 17412 | ScaCas9-Sc++ | 30 | 0 |
| 381 | ATG | GACCTCAATCCTTTGGGTGT | 17413 | SpyCas9-SpRY | 30 | 0 |
| 382 | CTT | CTCAAGCCTGTGGTTTTGGT | 17414 | SpyCas9-SpRY | 30 | 0 |
| 383 | TATGG | AAGACCTCAATCCTTTGGGTG | 17415 | SauCas9KKH | 31 | 0 |
| 384 | TAT | AGACCTCAATCCTTTGGGTG | 17416 | SpyCas9-SpRY | 31 | 0 |
| 385 | TCT | ACTCAAGCCTGTGGTTTTGG | 17417 | SpyCas9-SpRY | 31 | 0 |
| 386 | GTA | AAGACCTCAATCCTTTGGGT | 17418 | SpyCas9-SpRY | 32 | 0 |
| 387 | GTC | CACTCAAGCCTGTGGTTTTG | 17419 | SpyCas9-SpRY | 32 | 0 |
| 388 | TG | CAAGACCTCAATCCTTTGGG | 17420 | SpyCas9-NG | 33 | 0 |
| 389 | TG | CAAGACCTCAATCCTTTGGG | 17421 | SpyCas9-xCas | 33 | 0 |
| 390 | TG | CAAGACCTCAATCCTTTGGG | 17422 | SpyCas9-xCas-NG | 33 | 0 |
| 391 | GG | TCACTCAAGCCTGTGGTTTT | 17423 | SpyCas9-NG | 33 | 0 |
| 392 | GG | TCACTCAAGCCTGTGGTTTT | 17424 | SpyCas9-xCas | 33 | 0 |
| 393 | GG | TCACTCAAGCCTGTGGTTTT | 17425 | SpyCas9-xCas-NG | 33 | 0 |
| 394 | TGT | CAAGACCTCAATCCTTTGGG | 17426 | SpyCas9-SpG | 33 | 0 |
| 395 | TGT | CAAGACCTCAATCCTTTGGG | 17427 | SpyCas9-SpRY | 33 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 396 | GGT | TCACTCAAGCCTGTGGTTTT | 17428 | SpyCas9-SpG | 33 | 0 |
| 397 | GGT | TCACTCAAGCCTGTGGTTTT | 17429 | SpyCas9-SpRY | 33 | 0 |
| 398 | TGTA | CAAGACCTCAATCCTTTGGG | 17430 | SpyCas9-3var-NRTH | 33 | 0 |
| 399 | GGTC | TCACTCAAGCCTGTGGTTTT | 17431 | SpyCas9-3var-NRTH | 33 | 0 |
| 400 | GTG | CCAAGACCTCAATCCTTTGG | 17432 | ScaCas9 | 34 | 0 |
| 401 | GTG | CCAAGACCTCAATCCTTTGG | 17433 | ScaCas9-HiFi-Sc++ | 34 | 0 |
| 402 | GTG | CCAAGACCTCAATCCTTTGG | 17434 | ScaCas9-Sc++ | 34 | 0 |
| 403 | GTG | CCAAGACCTCAATCCTTTGG | 17435 | SpyCas9-SpRY | 34 | 0 |
| 404 | TGG | TTCACTCAAGCCTGTGGTTT | 17436 | ScaCas9 | 34 | 0 |
| 405 | TGG | TTCACTCAAGCCTGTGGTTT | 17437 | ScaCas9-HiFi-Sc++ | 34 | 0 |
| 406 | TGG | TTCACTCAAGCCTGTGGTTT | 17438 | ScaCas9-Sc++ | 34 | 0 |
| 407 | TGG | TTCACTCAAGCCTGTGGTTT | 17439 | SpyCas9 | 34 | 0 |
| 408 | TGG | TTCACTCAAGCCTGTGGTTT | 17440 | SpyCas9-HF1 | 34 | 0 |
| 409 | TGG | TTCACTCAAGCCTGTGGTTT | 17441 | SpyCas9-SpG | 34 | 0 |
| 410 | TGG | TTCACTCAAGCCTGTGGTTT | 17442 | SpyCas9-SpRY | 34 | 0 |
| 411 | TG | TTCACTCAAGCCTGTGGTTT | 17443 | SpyCas9-NG | 34 | 0 |
| 412 | TG | TTCACTCAAGCCTGTGGTTT | 17444 | SpyCas9-xCas | 34 | 0 |
| 413 | TG | TTCACTCAAGCCTGTGGTTT | 17445 | SpyCas9-xCas-NG | 34 | 0 |
| 414 | TGGTCTTA | ccctTCACTCAAGCCTGTGGTTT | 17446 | BlatCas9 | 34 | 0 |
| 415 | TGGTC | ccctTCACTCAAGCCTGTGGTTT | 17447 | BlatCas9 | 34 | 0 |
| 416 | TGGTCTT | CCTTCACTCAAGCCTGTGGTTT | 17448 | CdiCas9 | 34 | 0 |
| 417 | TGGT | TTCACTCAAGCCTGTGGTTT | 17449 | SpyCas9-3var-NRRH | 34 | 0 |
| 418 | TTGG | CCTTCACTCAAGCCTGTGGTT | 17450 | SauriCas9 | 35 | 0 |
| 419 | TTGG | CCTTCACTCAAGCCTGTGGTT | 17451 | SauriCas9-KKH | 35 | 0 |
| 420 | TTG | CTTCACTCAAGCCTGTGGTT | 17452 | ScaCas9 | 35 | 0 |
| 421 | TTG | CTTCACTCAAGCCTGTGGTT | 17453 | ScaCas9-HiFi-Sc++ | 35 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 422 | TTG | CTTCACTCAAGCCTGTGGTT | 17454 | ScaCas9-Sc++ | 35 | 0 |
| 423 | TTG | CTTCACTCAAGCCTGTGGTT | 17455 | SpyCas9-SpRY | 35 | 0 |
| 424 | GG | TCCAAGACCTCAATCCTTTG | 17456 | SpyCas9-NG | 35 | 0 |
| 425 | GG | TCCAAGACCTCAATCCTTTG | 17457 | SpyCas9-xCas | 35 | 0 |
| 426 | GG | TCCAAGACCTCAATCCTTTG | 17458 | SpyCas9-xCas-NG | 35 | 0 |
| 427 | GGT | TCCAAGACCTCAATCCTTTG | 17459 | SpyCas9-SpG | 35 | 0 |
| 428 | GGT | TCCAAGACCTCAATCCTTTG | 17460 | SpyCas9-SpRY | 35 | 0 |
| 429 | TTTGG | CCCTTCACTCAAGCCTGTGGT | 17461 | SauCas9KKH | 36 | 0 |
| 430 | TTTGGT | CCCTTCACTCAAGCCTGTGGT | 17462 | SauCas9KKH | 36 | 0 |
| 431 | GGG | GTCCAAGACCTCAATCCTTT | 17463 | ScaCas9 | 36 | 0 |
| 432 | GGG | GTCCAAGACCTCAATCCTTT | 17464 | ScaCas9-HiFi-Sc++ | 36 | 0 |
| 433 | GGG | GTCCAAGACCTCAATCCTTT | 17465 | ScaCas9-Sc++ | 36 | 0 |
| 434 | GGG | GTCCAAGACCTCAATCCTTT | 17466 | SpyCas9 | 36 | 0 |
| 435 | GGG | GTCCAAGACCTCAATCCTTT | 17467 | SpyCas9-HF1 | 36 | 0 |
| 436 | GGG | GTCCAAGACCTCAATCCTTT | 17468 | SpyCas9-SpG | 36 | 0 |
| 437 | GGG | GTCCAAGACCTCAATCCTTT | 17469 | SpyCas9-SpRY | 36 | 0 |
| 438 | GG | GTCCAAGACCTCAATCCTTT | 17470 | SpyCas9-NG | 36 | 0 |
| 439 | GG | GTCCAAGACCTCAATCCTTT | 17471 | SpyCas9-xCas | 36 | 0 |
| 440 | GG | GTCCAAGACCTCAATCCTTT | 17472 | SpyCas9-xCas-NG | 36 | 0 |
| 441 | TTT | CCTTCACTCAAGCCTGTGGT | 17473 | SpyCas9-SpRY | 36 | 0 |
| 442 | TTTGGTCT | gtgcCCTTCACTCAAGCCTGTGGT | 17474 | NmeCas9 | 36 | 0 |
| 443 | GGGT | GTCCAAGACCTCAATCCTTT | 17475 | SpyCas9-3var-NRRH | 36 | 0 |
| 444 | TGGG | TTGTCCAAGACCTCAATCCTT | 17476 | SauriCas9 | 37 | 0 |
| 445 | TGGG | TTGTCCAAGACCTCAATCCTT | 17477 | SauriCas9-KKH | 37 | 0 |
| 446 | TGG | TGTCCAAGACCTCAATCCTT | 17478 | ScaCas9 | 37 | 0 |
| 447 | TGG | TGTCCAAGACCTCAATCCTT | 17479 | ScaCas9-HiFi-Sc++ | 37 | 0 |
| 448 | TGG | TGTCCAAGACCTCAATCCTT | 17480 | ScaCas9-Sc++ | 37 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 449 | TGG | TGTCCAAGACCTCAATCCTT | 17481 | SpyCas9 | 37 | 0 |
| 450 | TGG | TGTCCAAGACCTCAATCCTT | 17482 | SpyCas9-HF1 | 37 | 0 |
| 451 | TGG | TGTCCAAGACCTCAATCCTT | 17483 | SpyCas9-SpG | 37 | 0 |
| 452 | TGG | TGTCCAAGACCTCAATCCTT | 17484 | SpyCas9-SpRY | 37 | 0 |
| 453 | TG | TGTCCAAGACCTCAATCCTT | 17485 | SpyCas9-NG | 37 | 0 |
| 454 | TG | TGTCCAAGACCTCAATCCTT | 17486 | SpyCas9-xCas | 37 | 0 |
| 455 | TG | TGTCCAAGACCTCAATCCTT | 17487 | SpyCas9-xCas-NG | 37 | 0 |
| 456 | TTT | CCCTTCACTCAAGCCTGTGG | 17488 | SpyCas9-SpRY | 37 | 0 |
| 457 | TGGGTG | TTGTCCAAGACCTCAATCCTT | 17489 | cCas9-v16 | 37 | 0 |
| 458 | TGGGTG | TTGTCCAAGACCTCAATCCTT | 17490 | cCas9-v21 | 37 | 0 |
| 459 | TTGGG | gtATTGTCCAAGACCTCAATCCT | 17491 | SauCas9 | 38 | 0 |
| 460 | TTGGG | ATTGTCCAAGACCTCAATCCT | 17492 | SauCas9KKH | 38 | 0 |
| 461 | TTGGGT | gtATTGTCCAAGACCTCAATCCT | 17493 | SauCas9 | 38 | 0 |
| 462 | TTGGGT | ATTGTCCAAGACCTCAATCCT | 17494 | SauCas9KKH | 38 | 0 |
| 463 | TTGGGT | ATTGTCCAAGACCTCAATCCT | 17495 | cCas9-v17 | 38 | 0 |
| 464 | TTGGGT | ATTGTCCAAGACCTCAATCCT | 17496 | cCas9-v42 | 38 | 0 |
| 465 | TTGG | ATTGTCCAAGACCTCAATCCT | 17497 | SauriCas9 | 38 | 0 |
| 466 | TTGG | ATTGTCCAAGACCTCAATCCT | 17498 | SauriCas9-KKH | 38 | 0 |
| 467 | TTG | TTGTCCAAGACCTCAATCCT | 17499 | ScaCas9 | 38 | 0 |
| 468 | TTG | TTGTCCAAGACCTCAATCCT | 17500 | ScaCas9-HiFi-Sc++ | 38 | 0 |
| 469 | TTG | TTGTCCAAGACCTCAATCCT | 17501 | ScaCas9-Sc++ | 38 | 0 |
| 470 | TTG | TTGTCCAAGACCTCAATCCT | 17502 | SpyCas9-SpRY | 38 | 0 |
| 471 | GTT | GCCCTTCACTCAAGCCTGTG | 17503 | SpyCas9-SpRY | 38 | 0 |
| 472 | TTTGG | TATTGTCCAAGACCTCAATCC | 17504 | SauCas9KKH | 39 | 0 |
| 473 | GG | TGCCCTTCACTCAAGCCTGT | 17505 | SpyCas9-NG | 39 | 0 |
| 474 | GG | TGCCCTTCACTCAAGCCTGT | 17506 | SpyCas9-xCas | 39 | 0 |
| 475 | GG | TGCCCTTCACTCAAGCCTGT | 17507 | SpyCas9-xCas-NG | 39 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 476 | GGT | TGCCCTTCACTCAAGCCTGT | 17508 | SpyCas9-SpG | 39 | 0 |
| 477 | GGT | TGCCCTTCACTCAAGCCTGT | 17509 | SpyCas9-SpRY | 39 | 0 |
| 478 | TTT | ATTGTCCAAGACCTCAATCC | 17510 | SpyCas9-SpRY | 39 | 0 |
| 479 | GGTT | TGCCCTTCACTCAAGCCTGT | 17511 | SpyCas9-3var-NRTH | 39 | 0 |
| 480 | TGG | GTGCCCTTCACTCAAGCCTG | 17512 | ScaCas9 | 40 | 0 |
| 481 | TGG | GTGCCCTTCACTCAAGCCTG | 17513 | ScaCas9-HiFi-Sc++ | 40 | 0 |
| 482 | TGG | GTGCCCTTCACTCAAGCCTG | 17514 | ScaCas9-Sc++ | 40 | 0 |
| 483 | TGG | GTGCCCTTCACTCAAGCCTG | 17515 | SpyCas9 | 40 | 0 |
| 484 | TGG | GTGCCCTTCACTCAAGCCTG | 17516 | SpyCas9-HF1 | 40 | 0 |
| 485 | TGG | GTGCCCTTCACTCAAGCCTG | 17517 | SpyCas9-SpG | 40 | 0 |
| 486 | TGG | GTGCCCTTCACTCAAGCCTG | 17518 | SpyCas9-SpRY | 40 | 0 |
| 487 | TG | GTGCCCTTCACTCAAGCCTG | 17519 | SpyCas9-NG | 40 | 0 |
| 488 | TG | GTGCCCTTCACTCAAGCCTG | 17520 | SpyCas9-xCas | 40 | 0 |
| 489 | TG | GTGCCCTTCACTCAAGCCTG | 17521 | SpyCas9-xCas-NG | 40 | 0 |
| 490 | CTT | TATTGTCCAAGACCTCAATC | 17522 | SpyCas9-SpRY | 40 | 0 |
| 491 | TGGTTTT | TGGTGCCCTTCACTCAAGCCTG | 17523 | CdiCas9 | 40 | 0 |
| 492 | TGGT | GTGCCCTTCACTCAAGCCTG | 17524 | SpyCas9-3var-NRRH | 40 | 0 |
| 493 | GTGG | TGGTGCCCTTCACTCAAGCCT | 17525 | SauriCas9 | 41 | 0 |
| 494 | GTGG | TGGTGCCCTTCACTCAAGCCT | 17526 | SauriCas9-KKH | 41 | 0 |
| 495 | GTG | GGTGCCCTTCACTCAAGCCT | 17527 | ScaCas9 | 41 | 0 |
| 496 | GTG | GGTGCCCTTCACTCAAGCCT | 17528 | ScaCas9-HiFi-Sc++ | 41 | 0 |
| 497 | GTG | GGTGCCCTTCACTCAAGCCT | 17529 | ScaCas9-Sc++ | 41 | 0 |
| 498 | GTG | GGTGCCCTTCACTCAAGCCT | 17530 | SpyCas9-SpRY | 41 | 0 |
| 499 | CCT | GTATTGTCCAAGACCTCAAT | 17531 | SpyCas9-SpRY | 41 | 0 |
| 500 | GTGGTT | TGGTGCCCTTCACTCAAGCCT | 17532 | cCas9-v16 | 41 | 0 |
| 501 | GTGGTT | TGGTGCCCTTCACTCAAGCCT | 17533 | cCas9-v21 | 41 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 502 | TGTGGTT | caaATGGTGCCCTTCACTCAAGCC | 17534 | PpnCas9 | 42 | 0 |
| 503 | TGTGG | ATGGTGCCCTTCACTCAAGCC | 17535 | SauCas9KKH | 42 | 0 |
| 504 | TGTGGT | ATGGTGCCCTTCACTCAAGCC | 17536 | SauCas9KKH | 42 | 0 |
| 505 | TG | TGGTGCCCTTCACTCAAGCC | 17537 | SpyCas9-NG | 42 | 0 |
| 506 | TG | TGGTGCCCTTCACTCAAGCC | 17538 | SpyCas9-xCas | 42 | 0 |
| 507 | TG | TGGTGCCCTTCACTCAAGCC | 17539 | SpyCas9-xCas-NG | 42 | 0 |
| 508 | TGT | TGGTGCCCTTCACTCAAGCC | 17540 | SpyCas9-SpG | 42 | 0 |
| 509 | TGT | TGGTGCCCTTCACTCAAGCC | 17541 | SpyCas9-SpRY | 42 | 0 |
| 510 | TCC | GGTATTGTCCAAGACCTCAA | 17542 | SpyCas9-SpRY | 42 | 0 |
| 511 | TGTGGTTT | caaaTGGTGCCCTTCACTCAAGCC | 17543 | NmeCas9 | 42 | 0 |
| 512 | CTG | ATGGTGCCCTTCACTCAAGC | 17544 | ScaCas9 | 43 | 0 |
| 513 | CTG | ATGGTGCCCTTCACTCAAGC | 17545 | ScaCas9-HiFi-Sc++ | 43 | 0 |
| 514 | CTG | ATGGTGCCCTTCACTCAAGC | 17546 | ScaCas9-Sc++ | 43 | 0 |
| 515 | CTG | ATGGTGCCCTTCACTCAAGC | 17547 | SpyCas9-SpRY | 43 | 0 |
| 516 | ATC | GGGTATTGTCCAAGACCTCA | 17548 | SpyCas9-SpRY | 43 | 0 |
| 517 | AAT | TGGGTATTGTCCAAGACCTC | 17549 | SpyCas9-SpRY | 44 | 0 |
| 518 | CCT | AATGGTGCCCTTCACTCAAG | 17550 | SpyCas9-SpRY | 44 | 0 |
| 519 | AATCCTTT | tgctGGGTATTGTCCAAGACCTC | 17551 | BlatCas9 | 44 | 0 |
| 520 | AATCC | tgctGGGTATTGTCCAAGACCTC | 17552 | BlatCas9 | 44 | 0 |
| 521 | AATC | TGGGTATTGTCCAAGACCTC | 17553 | SpyCas9-3var-NRTH | 44 | 0 |
| 522 | CAATCC | gcTGCTGGGTATTGTCCAAGACCT | 17554 | Nme2Cas9 | 45 | 0 |
| 523 | CAA | CTGGGTATTGTCCAAGACCT | 17555 | SpyCas9-SpRY | 45 | 0 |
| 524 | GCC | AAATGGTGCCCTTCACTCAA | 17556 | SpyCas9-SpRY | 45 | 0 |
| 525 | CAATCCTT | ctgcTGGGTATTGTCCAAGACCT | 17557 | BlatCas9 | 45 | 0 |
| 526 | CAATC | ctgcTGGGTATTGTCCAAGACCT | 17558 | BlatCas9 | 45 | 0 |
| 527 | CAATCCT | TGCTGGGTATTGTCCAAGACCT | 17559 | CdiCas9 | 45 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 528 | CAAT | CTGGGTATTGTCCAAGACCT | 17560 | SpyCas9-3var-NRRH | 45 | 0 |
| 529 | CAAT | gcTGGGTATTGTCCAAGACCT | 17561 | iSpyMacCas9 | 45 | 0 |
| 530 | AG | CAAATGGTGCCCTTCACTCA | 17562 | SpyCas9-NG | 46 | 0 |
| 531 | AG | CAAATGGTGCCCTTCACTCA | 17563 | SpyCas9-xCas | 46 | 0 |
| 532 | AG | CAAATGGTGCCCTTCACTCA | 17564 | SpyCas9-xCas-NG | 46 | 0 |
| 533 | AGC | CAAATGGTGCCCTTCACTCA | 17565 | SpyCas9-SpG | 46 | 0 |
| 534 | AGC | CAAATGGTGCCCTTCACTCA | 17566 | SpyCas9-SpRY | 46 | 0 |
| 535 | TCA | GCTGGGTATTGTCCAAGACC | 17567 | SpyCas9-SpRY | 46 | 0 |
| 536 | TCAATCC | CTGCTGGGTATTGTCCAAGACC | 17568 | CdiCas9 | 46 | 0 |
| 537 | AGCC | CAAATGGTGCCCTTCACTCA | 17569 | SpyCas9-3var-NRCH | 46 | 0 |
| 538 | CTCAA | CTGCTGGGTATTGTCCAAGAC | 17570 | SauCas9KKH | 47 | 0 |
| 539 | CTCAAT | CTGCTGGGTATTGTCCAAGAC | 17571 | SauCas9KKH | 47 | 0 |
| 540 | CTCAAT | CTGCTGGGTATTGTCCAAGAC | 17572 | cCas9-v17 | 47 | 0 |
| 541 | CTCAAT | CTGCTGGGTATTGTCCAAGAC | 17573 | cCas9-v42 | 47 | 0 |
| 542 | AAG | CCAAATGGTGCCCTTCACTC | 17574 | ScaCas9 | 47 | 0 |
| 543 | AAG | CCAAATGGTGCCCTTCACTC | 17575 | ScaCas9-HiFi-Sc++ | 47 | 0 |
| 544 | AAG | CCAAATGGTGCCCTTCACTC | 17576 | ScaCas9-Sc++ | 47 | 0 |
| 545 | AAG | CCAAATGGTGCCCTTCACTC | 17577 | SpyCas9-SpRY | 47 | 0 |
| 546 | CTC | TGCTGGGTATTGTCCAAGAC | 17578 | SpyCas9-SpRY | 47 | 0 |
| 547 | AAGCCTGT | tctcCAAATGGTGCCCTTCACTC | 17579 | BlatCas9 | 47 | 0 |
| 548 | AAGCC | tctcCAAATGGTGCCCTTCACTC | 17580 | BlatCas9 | 47 | 0 |
| 549 | AAGC | CCAAATGGTGCCCTTCACTC | 17581 | SpyCas9-3var-NRRH | 47 | 0 |
| 550 | CAAGCC | ttTCTCCAAATGGTGCCCTTCACT | 17582 | Nme2Cas9 | 48 | 0 |
| 551 | CAAG | CTCCAAATGGTGCCCTTCACT | 17583 | SauriCas9-KKH | 48 | 0 |
| 552 | CAAG | TCCAAATGGTGCCCTTCACT | 17584 | SpyCas9-QQR1 | 48 | 0 |
| 553 | CAAG | ctCCAAATGGTGCCCTTCACT | 17585 | iSpy MacCas9 | 48 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 554 | CAA | TCCAAATGGTGCCCTTCACT | 17586 | SpyCas9-SpRY | 48 | 0 |
| 555 | CCT | CTGCTGGGTATTGTCCAAGA | 17587 | SpyCas9-SpRY | 48 | 0 |
| 556 | CAAGCCTG | ttctCCAAATGGTGCCCTTCACT | 17588 | BlatCas9 | 48 | 0 |
| 557 | CAAGC | ttctCCAAATGGTGCCCTTCACT | 17589 | BlatCas9 | 48 | 0 |
| 558 | TCAAG | TCTCCAAATGGTGCCCTTCAC | 17590 | SauCas9KKH | 49 | 0 |
| 559 | ACC | GCTGCTGGGTATTGTCCAAG | 17591 | SpyCas9-SpRY | 49 | 0 |
| 560 | TCA | CTCCAAATGGTGCCCTTCAC | 17592 | SpyCas9-SpRY | 49 | 0 |
| 561 | ACCTCAAT | taagCTGCTGGGTATTGTCCAAG | 17593 | BlatCas9 | 49 | 0 |
| 562 | ACCTC | taagCTGCTGGGTATTGTCCAAG | 17594 | BlatCas9 | 49 | 0 |
| 563 | TCAAGC | TCTCCAAATGGTGCCCTTCAC | 17595 | cCas9-v17 | 49 | 0 |
| 564 | TCAAGC | TCTCCAAATGGTGCCCTTCAC | 17596 | cCas9-v42 | 49 | 0 |
| 565 | CTCAA | TTCTCCAAATGGTGCCCTTCA | 17597 | SauCas9KKH | 50 | 0 |
| 566 | GAC | AGCTGCTGGGTATTGTCCAA | 17598 | SpyCas9-SpRY | 50 | 0 |
| 567 | CTC | TCTCCAAATGGTGCCCTTCA | 17599 | SpyCas9-SpRY | 50 | 0 |
| 568 | CTCAAG | TTCTCCAAATGGTGCCCTTCA | 17600 | cCas9-v17 | 50 | 0 |
| 569 | CTCAAG | TTCTCCAAATGGTGCCCTTCA | 17601 | cCas9-v42 | 50 | 0 |
| 570 | GACC | AGCTGCTGGGTATTGTCCAA | 17602 | SpyCas9-3var-NRCH | 50 | 0 |
| 571 | AG | AAGCTGCTGGGTATTGTCCA | 17603 | SpyCas9-NG | 51 | 0 |
| 572 | AG | AAGCTGCTGGGTATTGTCCA | 17604 | SpyCas9-xCas | 51 | 0 |
| 573 | AG | AAGCTGCTGGGTATTGTCCA | 17605 | SpyCas9-xCas-NG | 51 | 0 |
| 574 | AGA | AAGCTGCTGGGTATTGTCCA | 17606 | SpyCas9-SpG | 51 | 0 |
| 575 | AGA | AAGCTGCTGGGTATTGTCCA | 17607 | SpyCas9-SpRY | 51 | 0 |
| 576 | ACT | TTCTCCAAATGGTGCCCTTC | 17608 | SpyCas9-SpRY | 51 | 0 |
| 577 | AGACC | cttaAGCTGCTGGGTATTGTCCA | 17609 | BlatCas9 | 51 | 0 |
| 578 | AGACCTC | TTAAGCTGCTGGGTATTGTCCA | 17610 | CdiCas9 | 51 | 0 |
| 579 | AGAC | AAGCTGCTGGGTATTGTCCA | 17611 | SpyCas9-3var-NRRH | 51 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 580 | AGAC | AAGCTGCTGGGTATTGTCCA | 17612 | SpyCas9-VQR | 51 | 0 |
| 581 | AAGACC | atCTTAAGCTGCTGGGTATTGTCC | 17613 | Nme2Cas9 | 52 | 0 |
| 582 | AAG | TAAGCTGCTGGGTATTGTCC | 17614 | ScaCas9 | 52 | 0 |
| 583 | AAG | TAAGCTGCTGGGTATTGTCC | 17615 | ScaCas9-HiFi-Sc++ | 52 | 0 |
| 584 | AAG | TAAGCTGCTGGGTATTGTCC | 17616 | ScaCas9-Sc++ | 52 | 0 |
| 585 | AAG | TAAGCTGCTGGGTATTGTCC | 17617 | SpyCas9-SpRY | 52 | 0 |
| 586 | CAC | TTTCTCCAAATGGTGCCCTT | 17618 | SpyCas9-SpRY | 52 | 0 |
| 587 | CACTCAAG | acctTTCTCCAAATGGTGCCCTT | 17619 | BlatCas9 | 52 | 0 |
| 588 | AAGAC | tcttAAGCTGCTGGGTATTGTCC | 17620 | BlatCas9 | 52 | 0 |
| 589 | CACTC | acctTTCTCCAAATGGTGCCCTT | 17621 | BlatCas9 | 52 | 0 |
| 590 | AAGACCT | CTTAAGCTGCTGGGTATTGTCC | 17622 | CdiCas9 | 52 | 0 |
| 591 | AAGA | TAAGCTGCTGGGTATTGTCC | 17623 | SpyCas9-3var-NRRH | 52 | 0 |
| 592 | CACT | TTTCTCCAAATGGTGCCCTT | 17624 | SpyCas9-3var-NRCH | 52 | 0 |
| 593 | CAAGA | CTTAAGCTGCTGGGTATTGTC | 17625 | SauCas9KKH | 53 | 0 |
| 594 | CAAG | CTTAAGCTGCTGGGTATTGTC | 17626 | SauriCas9-KKH | 53 | 0 |
| 595 | CAAG | TTAAGCTGCTGGGTATTGTC | 17627 | SpyCas9-QQR1 | 53 | 0 |
| 596 | CAAG | ctTAAGCTGCTGGGTATTGTC | 17628 | iSpyMacCas9 | 53 | 0 |
| 597 | CAA | TTAAGCTGCTGGGTATTGTC | 17629 | SpyCas9-SpRY | 53 | 0 |
| 598 | TCA | CTTTCTCCAAATGGTGCCCT | 17630 | SpyCas9-SpRY | 53 | 0 |
| 599 | CAAGAC | CTTAAGCTGCTGGGTATTGTC | 17631 | cCas9-v17 | 53 | 0 |
| 600 | CAAGAC | CTTAAGCTGCTGGGTATTGTC | 17632 | cCas9-v42 | 53 | 0 |
| 601 | CCAAG | TCTTAAGCTGCTGGGTATTGT | 17633 | SauCas9KKH | 54 | 0 |
| 602 | CCA | CTTAAGCTGCTGGGTATTGT | 17634 | SpyCas9-SpRY | 54 | 0 |
| 603 | TTC | CCTTTCTCCAAATGGTGCCC | 17635 | SpyCas9-SpRY | 54 | 0 |
| 604 | TTCAC | ctacCTTTCTCCAAATGGTGCCC | 17636 | BlatCas9 | 54 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 605 | TTCACT | ACCTTTCTCCAAATGGTGCCC | 17637 | cCas9-v16 | 54 | 0 |
| 606 | TTCACT | ACCTTTCTCCAAATGGTGCCC | 17638 | cCas9-v21 | 54 | 0 |
| 607 | CCAAGA | TCTTAAGCTGCTGGGTATTGT | 17639 | cCas9-v17 | 54 | 0 |
| 608 | CCAAGA | TCTTAAGCTGCTGGGTATTGT | 17640 | cCas9-v42 | 54 | 0 |
| 609 | TCCAA | ATCTTAAGCTGCTGGGTATTG | 17641 | SauCas9KKH | 55 | 0 |
| 610 | TCC | TCTTAAGCTGCTGGGTATTG | 17642 | SpyCas9-SpRY | 55 | 0 |
| 611 | CTT | ACCTTTCTCCAAATGGTGCC | 17643 | SpyCas9-SpRY | 55 | 0 |
| 612 | TCCAAG | ATCTTAAGCTGCTGGGTATTG | 17644 | cCas9-v17 | 55 | 0 |
| 613 | TCCAAG | ATCTTAAGCTGCTGGGTATTG | 17645 | cCas9-v42 | 55 | 0 |
| 614 | GTC | ATCTTAAGCTGCTGGGTATT | 17646 | SpyCas9-SpRY | 56 | 0 |
| 615 | CCT | TACCTTTCTCCAAATGGTGC | 17647 | SpyCas9-SpRY | 56 | 0 |
| 616 | CCTTC | gactACCTTTCTCCAAATGGTGC | 17648 | BlatCas9 | 56 | 0 |
| 617 | TG | AATCTTAAGCTGCTGGGTAT | 17649 | SpyCas9-NG | 57 | 0 |
| 618 | TG | AATCTTAAGCTGCTGGGTAT | 17650 | SpyCas9-xCas | 57 | 0 |
| 619 | TG | AATCTTAAGCTGCTGGGTAT | 17651 | SpyCas9-xCas-NG | 57 | 0 |
| 620 | TGT | AATCTTAAGCTGCTGGGTAT | 17652 | SpyCas9-SpG | 57 | 0 |
| 621 | TGT | AATCTTAAGCTGCTGGGTAT | 17653 | SpyCas9-SpRY | 57 | 0 |
| 622 | CCC | CTACCTTTCTCCAAATGGTG | 17654 | SpyCas9-SpRY | 57 | 0 |
| 623 | TGTCCAAG | caaaATCTTAAGCTGCTGGGTAT | 17655 | BlatCas9 | 57 | 0 |
| 624 | TGTCC | caaaATCTTAAGCTGCTGGGTAT | 17656 | BlatCas9 | 57 | 0 |
| 625 | TGTC | AATCTTAAGCTGCTGGGTAT | 17657 | SpyCas9-3var-NRTH | 57 | 0 |
| 626 | TTGTCC | gcCAAAATCTTAAGCTGCTGGGTA | 17658 | Nme2Cas9 | 58 | 0 |
| 627 | TTG | AAATCTTAAGCTGCTGGGTA | 17659 | ScaCas9 | 58 | 0 |
| 628 | TTG | AAATCTTAAGCTGCTGGGTA | 17660 | ScaCas9-HiFi-Sc++ | 58 | 0 |
| 629 | TTG | AAATCTTAAGCTGCTGGGTA | 17661 | ScaCas9-Sc++ | 58 | 0 |
| 630 | TTG | AAATCTTAAGCTGCTGGGTA | 17662 | SpyCas9-SpRY | 58 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 631 | GCC | ACTACCTTTCTCCAAATGGT | 17663 | SpyCas9-SpRY | 58 | 0 |
| 632 | TTGTCCAA | ccaaAATCTTAAGCTGCTGGGTA | 17664 | BlatCas9 | 58 | 0 |
| 633 | TTGTCCAA | ccaaAATCTTAAGCTGCTGGGTA | 17665 | BlatCas9 | 58 | 0 |
| 634 | TTGTC | ccaaAATCTTAAGCTGCTGGGTA | 17666 | BlatCas9 | 58 | 0 |
| 635 | TG | GACTACCTTTCTCCAAATGG | 17667 | SpyCas9-NG | 59 | 0 |
| 636 | TG | GACTACCTTTCTCCAAATGG | 17668 | SpyCas9-xCas | 59 | 0 |
| 637 | TG | GACTACCTTTCTCCAAATGG | 17669 | SpyCas9-xCas-NG | 59 | 0 |
| 638 | TGC | GACTACCTTTCTCCAAATGG | 17670 | SpyCas9-SpG | 59 | 0 |
| 639 | TGC | GACTACCTTTCTCCAAATGG | 17671 | SpyCas9-SpRY | 59 | 0 |
| 640 | ATT | AAAATCTTAAGCTGCTGGGT | 17672 | SpyCas9-SpRY | 59 | 0 |
| 641 | TGCCC | taagACTACCTTTCTCCAAATGG | 17673 | BlatCas9 | 59 | 0 |
| 642 | TGCC | GACTACCTTTCTCCAAATGG | 17674 | SpyCas9-3var-NRCH | 59 | 0 |
| 643 | GTGCCC | ctTAAGACTACCTTTCTCCAAATG | 17675 | Nme2Cas9 | 60 | 0 |
| 644 | GTG | AGACTACCTTTCTCCAAATG | 17676 | ScaCas9 | 60 | 0 |
| 645 | GTG | AGACTACCTTTCTCCAAATG | 17677 | ScaCas9-HiFi-Sc++ | 60 | 0 |
| 646 | GTG | AGACTACCTTTCTCCAAATG | 17678 | ScaCas9-Sc++ | 60 | 0 |
| 647 | GTG | AGACTACCTTTCTCCAAATG | 17679 | SpyCas9-SpRY | 60 | 0 |
| 648 | TAT | CAAAATCTTAAGCTGCTGGG | 17680 | SpyCas9-SpRY | 60 | 0 |
| 649 | GTGCCCTT | ttaaGACTACCTTTCTCCAAATG | 17681 | BlatCas9 | 60 | 0 |
| 650 | GTGCC | ttaaGACTACCTTTCTCCAAATG | 17682 | BlatCas9 | 60 | 0 |
| 651 | GTGCCCT | TAAGACTACCTTTCTCCAAATG | 17683 | CdiCas9 | 60 | 0 |
| 652 | TATT | CAAAATCTTAAGCTGCTGGG | 17684 | SpyCas9-3var-NRTH | 60 | 0 |
| 653 | GGTGCC | tcTTAAGACTACCTTTCTCCAAAT | 17685 | Nme2Cas9 | 61 | 0 |
| 654 | GG | AAGACTACCTTTCTCCAAAT | 17686 | SpyCas9-NG | 61 | 0 |
| 655 | GG | AAGACTACCTTTCTCCAAAT | 17687 | SpyCas9-xCas | 61 | 0 |
| 656 | GG | AAGACTACCTTTCTCCAAAT | 17688 | SpyCas9-xCas-NG | 61 | 0 |
| 657 | GGT | AAGACTACCTTTCTCCAAAT | 17689 | SpyCas9-SpG | 61 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 658 | GGT | AAGACTACCTTTCTCCAAAT | 17690 | SpyCas9-SpRY | 61 | 0 |
| 659 | GTA | CCAAAATCTTAAGCTGCTGG | 17691 | SpyCas9-SpRY | 61 | 0 |
| 660 | GGTGC | cttaAGACTACCTTTCTCCAAAT | 17692 | BlatCas9 | 61 | 0 |
| 661 | TGG | TAAGACTACCTTTCTCCAAA | 17693 | ScaCas9 | 62 | 0 |
| 662 | TGG | TAAGACTACCTTTCTCCAAA | 17694 | ScaCas9-HiFi-Sc++ | 62 | 0 |
| 663 | TGG | TAAGACTACCTTTCTCCAAA | 17695 | ScaCas9-Sc++ | 62 | 0 |
| 664 | TGG | TAAGACTACCTTTCTCCAAA | 17696 | SpyCas9 | 62 | 0 |
| 665 | TGG | TAAGACTACCTTTCTCCAAA | 17697 | SpyCas9-HF1 | 62 | 0 |
| 666 | TGG | TAAGACTACCTTTCTCCAAA | 17698 | SpyCas9-SpG | 62 | 0 |
| 667 | TGG | TAAGACTACCTTTCTCCAAA | 17699 | SpyCas9-SpRY | 62 | 0 |
| 668 | GG | GCCAAAATCTTAAGCTGCTG | 17700 | SpyCas9-NG | 62 | 0 |
| 669 | GG | GCCAAAATCTTAAGCTGCTG | 17701 | SpyCas9-xCas | 62 | 0 |
| 670 | GG | GCCAAAATCTTAAGCTGCTG | 17702 | SpyCas9-xCas-NG | 62 | 0 |
| 671 | TG | TAAGACTACCTTTCTCCAAA | 17703 | SpyCas9-NG | 62 | 0 |
| 672 | TG | TAAGACTACCTTTCTCCAAA | 17704 | SpyCas9-xCas | 62 | 0 |
| 673 | TG | TAAGACTACCTTTCTCCAAA | 17705 | SpyCas9-xCas-NG | 62 | 0 |
| 674 | GGT | GCCAAAATCTTAAGCTGCTG | 17706 | SpyCas9-SpG | 62 | 0 |
| 675 | GGT | GCCAAAATCTTAAGCTGCTG | 17707 | SpyCas9-SpRY | 62 | 0 |
| 676 | TGGT | TAAGACTACCTTTCTCCAAA | 17708 | SpyCas9-3var-NRRH | 62 | 0 |
| 677 | GGTA | GCCAAAATCTTAAGCTGCTG | 17709 | SpyCas9-3var-NRTH | 62 | 0 |
| 678 | GGGTATT | TCAGCCAAAATCTTAAGCTGCT | 17710 | CdiCas9 | 63 | 0 |
| 679 | GGGTATT | aatCAGCCAAAATCTTAAGCTGCT | 17711 | PpnCas9 | 63 | 0 |
| 680 | ATGG | CTTAAGACTACCTTTCTCCAA | 17712 | SauriCas9 | 63 | 0 |
| 681 | ATGG | CTTAAGACTACCTTTCTCCAA | 17713 | SauriCas9-KKH | 63 | 0 |
| 682 | GGG | AGCCAAAATCTTAAGCTGCT | 17714 | ScaCas9 | 63 | 0 |
| 683 | GGG | AGCCAAAATCTTAAGCTGCT | 17715 | ScaCas9-HiFi-Sc++ | 63 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 684 | GGG | AGCCAAAATCTTAAGCTGCT | 17716 | ScaCas9-Sc++ | 63 | 0 |
| 685 | GGG | AGCCAAAATCTTAAGCTGCT | 17717 | SpyCas9 | 63 | 0 |
| 686 | GGG | AGCCAAAATCTTAAGCTGCT | 17718 | SpyCas9-HF1 | 63 | 0 |
| 687 | GGG | AGCCAAAATCTTAAGCTGCT | 17719 | SpyCas9-SpG | 63 | 0 |
| 688 | GGG | AGCCAAAATCTTAAGCTGCT | 17720 | SpyCas9-SpRY | 63 | 0 |
| 689 | ATG | TTAAGACTACCTTTCTCCAA | 17721 | ScaCas9 | 63 | 0 |
| 690 | ATG | TTAAGACTACCTTTCTCCAA | 17722 | ScaCas9-HiFi-Sc++ | 63 | 0 |
| 691 | ATG | TTAAGACTACCTTTCTCCAA | 17723 | ScaCas9-Sc++ | 63 | 0 |
| 692 | ATG | TTAAGACTACCTTTCTCCAA | 17724 | SpyCas9-SpRY | 63 | 0 |
| 693 | GG | AGCCAAAATCTTAAGCTGCT | 17725 | SpyCas9-NG | 63 | 0 |
| 694 | GG | AGCCAAAATCTTAAGCTGCT | 17726 | SpyCas9-xCas | 63 | 0 |
| 695 | GG | AGCCAAAATCTTAAGCTGCT | 17727 | SpyCas9-xCas-NG | 63 | 0 |
| 696 | ATGGTG | CTTAAGACTACCTTTCTCCAA | 17728 | cCas9-v16 | 63 | 0 |
| 697 | ATGGTG | CTTAAGACTACCTTTCTCCAA | 17729 | cCas9-v21 | 63 | 0 |
| 698 | GGGT | AGCCAAAATCTTAAGCTGCT | 17730 | SpyCas9-3var-NRRH | 63 | 0 |
| 699 | AATGG | TCTTAAGACTACCTTTCTCCA | 17731 | SauCas9KKH | 64 | 0 |
| 700 | AATGGT | TCTTAAGACTACCTTTCTCCA | 17732 | SauCas9KKH | 64 | 0 |
| 701 | TGGG | TCAGCCAAAATCTTAAGCTGC | 17733 | SauriCas9 | 64 | 0 |
| 702 | TGGG | TCAGCCAAAATCTTAAGCTGC | 17734 | SauriCas9-KKH | 64 | 0 |
| 703 | TGG | CAGCCAAAATCTTAAGCTGC | 17735 | ScaCas9 | 64 | 0 |
| 704 | TGG | CAGCCAAAATCTTAAGCTGC | 17736 | ScaCas9-HiFi-Sc++ | 64 | 0 |
| 705 | TGG | CAGCCAAAATCTTAAGCTGC | 17737 | ScaCas9-Sc++ | 64 | 0 |
| 706 | TGG | CAGCCAAAATCTTAAGCTGC | 17738 | SpyCas9 | 64 | 0 |
| 707 | TGG | CAGCCAAAATCTTAAGCTGC | 17739 | SpyCas9-HF1 | 64 | 0 |
| 708 | TGG | CAGCCAAAATCTTAAGCTGC | 17740 | SpyCas9-SpG | 64 | 0 |
| 709 | TGG | CAGCCAAAATCTTAAGCTGC | 17741 | SpyCas9-SpRY | 64 | 0 |
| 710 | TG | CAGCCAAAATCTTAAGCTGC | 17742 | SpyCas9-NG | 64 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 711 | TG | CAGCCAAAATCTTAAGCTGC | 17743 | SpyCas9-xCas | 64 | 0 |
| 712 | TG | CAGCCAAAATCTTAAGCTGC | 17744 | SpyCas9-xCas-NG | 64 | 0 |
| 713 | AAT | CTTAAGACTACCTTTCTCCA | 17745 | SpyCas9-SpRY | 64 | 0 |
| 714 | CTGGG | gaATCAGCCAAAATCTTAAGCTG | 17746 | SauCas9 | 65 | 0 |
| 715 | CTGGG | ATCAGCCAAAATCTTAAGCTG | 17747 | SauCas9KKH | 65 | 0 |
| 716 | CTGGGT | gaATCAGCCAAAATCTTAAGCTG | 17748 | SauCas9 | 65 | 0 |
| 717 | CTGGGT | ATCAGCCAAAATCTTAAGCTG | 17749 | SauCas9KKH | 65 | 0 |
| 718 | CTGGGT | ATCAGCCAAAATCTTAAGCTG | 17750 | cCas9-v17 | 65 | 0 |
| 719 | CTGGGT | ATCAGCCAAAATCTTAAGCTG | 17751 | cCas9-v42 | 65 | 0 |
| 720 | CTGG | ATCAGCCAAAATCTTAAGCTG | 17752 | SauriCas9 | 65 | 0 |
| 721 | CTGG | ATCAGCCAAAATCTTAAGCTG | 17753 | SauriCas9-KKH | 65 | 0 |
| 722 | CTG | TCAGCCAAAATCTTAAGCTG | 17754 | ScaCas9 | 65 | 0 |
| 723 | CTG | TCAGCCAAAATCTTAAGCTG | 17755 | ScaCas9-HiFi-Sc++ | 65 | 0 |
| 724 | CTG | TCAGCCAAAATCTTAAGCTG | 17756 | ScaCas9-Sc++ | 65 | 0 |
| 725 | CTG | TCAGCCAAAATCTTAAGCTG | 17757 | SpyCas9-SpRY | 65 | 0 |
| 726 | AAA | TCTTAAGACTACCTTTCTCC | 17758 | SpyCas9-SpRY | 65 | 0 |
| 727 | AAAT | TCTTAAGACTACCTTTCTCC | 17759 | SpyCas9-3var-NRRH | 65 | 0 |
| 728 | AAAT | ctCTTAAGACTACCTTTCTCC | 17760 | iSpyMacCas9 | 65 | 0 |
| 729 | GCTGG | AATCAGCCAAAATCTTAAGCT | 17761 | SauCas9KKH | 66 | 0 |
| 730 | CAA | CTCTTAAGACTACCTTTCTC | 17762 | SpyCas9-SpRY | 66 | 0 |
| 731 | GCT | ATCAGCCAAAATCTTAAGCT | 17763 | SpyCas9-SpRY | 66 | 0 |
| 732 | CAAA | CTCTTAAGACTACCTTTCTC | 17764 | SpyCas9-3var-NRRH | 66 | 0 |
| 733 | CAAA | tcTCTTAAGACTACCTTTCTC | 17765 | iSpyMacCas9 | 66 | 0 |
| 734 | CCAAA | CTCTCTTAAGACTACCTTTCT | 17766 | SauCas9KKH | 67 | 0 |
| 735 | CCAAAT | CTCTCTTAAGACTACCTTTCT | 17767 | SauCas9KKH | 67 | 0 |
| 736 | CCAAAT | CTCTCTTAAGACTACCTTTCT | 17768 | cCas9-v17 | 67 | 0 |
| 737 | CCAAAT | CTCTCTTAAGACTACCTTTCT | 17769 | cCas9-v42 | 67 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 738 | TG | AATCAGCCAAAATCTTAAGC | 17770 | SpyCas9-NG | 67 | 0 |
| 739 | TG | AATCAGCCAAAATCTTAAGC | 17771 | SpyCas9-xCas | 67 | 0 |
| 740 | TG | AATCAGCCAAAATCTTAAGC | 17772 | SpyCas9-xCas-NG | 67 | 0 |
| 741 | TGC | AATCAGCCAAAATCTTAAGC | 17773 | SpyCas9-SpG | 67 | 0 |
| 742 | TGC | AATCAGCCAAAATCTTAAGC | 17774 | SpyCas9-SpRY | 67 | 0 |
| 743 | CCA | TCTCTTAAGACTACCTTTCT | 17775 | SpyCas9-SpRY | 67 | 0 |
| 744 | TGCT | AATCAGCCAAAATCTTAAGC | 17776 | SpyCas9-3var-NRCH | 67 | 0 |
| 745 | TCCAA | ACTCTCTTAAGACTACCTTTC | 17777 | SauCas9KKH | 68 | 0 |
| 746 | CTG | GAATCAGCCAAAATCTTAAG | 17778 | ScaCas9 | 68 | 0 |
| 747 | CTG | GAATCAGCCAAAATCTTAAG | 17779 | ScaCas9-HiFi-Sc++ | 68 | 0 |
| 748 | CTG | GAATCAGCCAAAATCTTAAG | 17780 | ScaCas9-Sc++ | 68 | 0 |
| 749 | CTG | GAATCAGCCAAAATCTTAAG | 17781 | SpyCas9-SpRY | 68 | 0 |
| 750 | TCC | CTCTCTTAAGACTACCTTTC | 17782 | SpyCas9-SpRY | 68 | 0 |
| 751 | TCCAAA | ACTCTCTTAAGACTACCTTTC | 17783 | cCas9-v17 | 68 | 0 |
| 752 | TCCAAA | ACTCTCTTAAGACTACCTTTC | 17784 | cCas9-v42 | 68 | 0 |
| 753 | GCT | GGAATCAGCCAAAATCTTAA | 17785 | SpyCas9-SpRY | 69 | 0 |
| 754 | CTC | ACTCTCTTAAGACTACCTTT | 17786 | SpyCas9-SpRY | 69 | 0 |
| 755 | GCTGCTGG | aatgGAATCAGCCAAAATCTTAA | 17787 | BlatCas9 | 69 | 0 |
| 756 | GCTGC | aatgGAATCAGCCAAAATCTTAA | 17788 | BlatCas9 | 69 | 0 |
| 757 | AG | TGGAATCAGCCAAAATCTTA | 17789 | SpyCas9-NG | 70 | 0 |
| 758 | AG | TGGAATCAGCCAAAATCTTA | 17790 | SpyCas9-xCas | 70 | 0 |
| 759 | AG | TGGAATCAGCCAAAATCTTA | 17791 | SpyCas9-xCas-NG | 70 | 0 |
| 760 | AGC | TGGAATCAGCCAAAATCTTA | 17792 | SpyCas9-SpG | 70 | 0 |
| 761 | AGC | TGGAATCAGCCAAAATCTTA | 17793 | SpyCas9-SpRY | 70 | 0 |
| 762 | TCT | AACTCTCTTAAGACTACCTT | 17794 | SpyCas9-SpRY | 70 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 763 | TCTCCAAA | gagaACTCTCTTAAGACTACCTT | 17795 | BlatCas9 | 70 | 0 |
| 764 | TCTCCAAA | gagaACTCTCTTAAGACTACCTT | 17796 | BlatCas9 | 70 | 0 |
| 765 | TCTCCAAA | gaGAACTCTCTTAAGACTACCTT | 17797 | GeoCas9 | 70 | 0 |
| 766 | TCTCC | gagaACTCTCTTAAGACTACCTT | 17798 | BlatCas9 | 70 | 0 |
| 767 | AGCT | TGGAATCAGCCAAAATCTTA | 17799 | SpyCas9-3var-NRCH | 70 | 0 |
| 768 | TTCTCC | ctGAGAACTCTCTTAAGACTACCT | 17800 | Nme2Cas9 | 71 | 0 |
| 769 | AAG | ATGGAATCAGCCAAAATCTT | 17801 | ScaCas9 | 71 | 0 |
| 770 | AAG | ATGGAATCAGCCAAAATCTT | 17802 | ScaCas9-HiFi-Sc++ | 71 | 0 |
| 771 | AAG | ATGGAATCAGCCAAAATCTT | 17803 | ScaCas9-Sc++ | 71 | 0 |
| 772 | AAG | ATGGAATCAGCCAAAATCTT | 17804 | SpyCas9-SpRY | 71 | 0 |
| 773 | TTC | GAACTCTCTTAAGACTACCT | 17805 | SpyCas9-SpRY | 71 | 0 |
| 774 | TTCTCCAA | tgagAACTCTCTTAAGACTACCT | 17806 | BlatCas9 | 71 | 0 |
| 775 | TTCTCCAA | tgagAACTCTCTTAAGACTACCT | 17807 | BlatCas9 | 71 | 0 |
| 776 | TTCTC | tgagAACTCTCTTAAGACTACCT | 17808 | BlatCas9 | 71 | 0 |
| 777 | AAGC | ATGGAATCAGCCAAAATCTT | 17809 | SpyCas9-3var-NRRH | 71 | 0 |
| 778 | TAAG | TAATGGAATCAGCCAAAATCT | 17810 | SauriCas9-KKH | 72 | 0 |
| 779 | TAAG | AATGGAATCAGCCAAAATCT | 17811 | SpyCas9-QQR1 | 72 | 0 |
| 780 | TAAG | taATGGAATCAGCCAAAATCT | 17812 | iSpy MacCas9 | 72 | 0 |
| 781 | TAA | AATGGAATCAGCCAAAATCT | 17813 | SpyCas9-SpRY | 72 | 0 |
| 782 | TTT | AGAACTCTCTTAAGACTACC | 17814 | SpyCas9-SpRY | 72 | 0 |
| 783 | TAAGC | gttaATGGAATCAGCCAAAATCT | 17815 | BlatCas9 | 72 | 0 |
| 784 | TAAGCT | TAATGGAATCAGCCAAAATCT | 17816 | cCas9-v16 | 72 | 0 |
| 785 | TAAGCT | TAATGGAATCAGCCAAAATCT | 17817 | cCas9-v21 | 72 | 0 |
| 786 | TTAAG | TTAATGGAATCAGCCAAAATC | 17818 | SauCas9KKH | 73 | 0 |
| 787 | TTA | TAATGGAATCAGCCAAAATC | 17819 | SpyCas9-SpRY | 73 | 0 |
| 788 | CTT | GAGAACTCTCTTAAGACTAC | 17820 | SpyCas9-SpRY | 73 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 789 | CTTTC | actgAGAACTCTCTTAAGACTAC | 17821 | BlatCas9 | 73 | 0 |
| 790 | TTAAGC | TTAATGGAATCAGCCAAAATC | 17822 | cCas9-v17 | 73 | 0 |
| 791 | TTAAGC | TTAATGGAATCAGCCAAAATC | 17823 | cCas9-v42 | 73 | 0 |
| 792 | CTTAA | GTTAATGGAATCAGCCAAAAT | 17824 | SauCas9KKH | 74 | 0 |
| 793 | CTT | TTAATGGAATCAGCCAAAAT | 17825 | SpyCas9-SpRY | 74 | 0 |
| 794 | CCT | TGAGAACTCTCTTAAGACTA | 17826 | SpyCas9-SpRY | 74 | 0 |
| 795 | TCT | GTTAATGGAATCAGCCAAAA | 17827 | SpyCas9-SpRY | 75 | 0 |
| 796 | ACC | CTGAGAACTCTCTTAAGACT | 17828 | SpyCas9-SpRY | 75 | 0 |
| 797 | TAC | ACTGAGAACTCTCTTAAGAC | 17829 | SpyCas9-SpRY | 76 | 0 |
| 798 | ATC | TGTTAATGGAATCAGCCAAA | 17830 | SpyCas9-SpRY | 76 | 0 |
| 799 | TACC | ACTGAGAACTCTCTTAAGAC | 17831 | SpyCas9-3var-NRCH | 76 | 0 |
| 800 | AAT | CTGTTAATGGAATCAGCCAA | 17832 | SpyCas9-SpRY | 77 | 0 |
| 801 | CTA | CACTGAGAACTCTCTTAAGA | 17833 | SpyCas9-SpRY | 77 | 0 |
| 802 | CTACCTTT | tgccACTGAGAACTCTCTTAAGA | 17834 | BlatCas9 | 77 | 0 |
| 803 | CTACC | tgccACTGAGAACTCTCTTAAGA | 17835 | BlatCas9 | 77 | 0 |
| 804 | CTACCTT | GCCACTGAGAACTCTCTTAAGA | 17836 | CdiCas9 | 77 | 0 |
| 805 | AATC | CTGTTAATGGAATCAGCCAA | 17837 | SpyCas9-3var-NRTH | 77 | 0 |
| 806 | ACTACC | aaTGCCACTGAGAACTCTCTTAAG | 17838 | Nme2Cas9 | 78 | 0 |
| 807 | AAA | ACTGTTAATGGAATCAGCCA | 17839 | SpyCas9-SpRY | 78 | 0 |
| 808 | ACT | CCACTGAGAACTCTCTTAAG | 17840 | SpyCas9-SpRY | 78 | 0 |
| 809 | AAATCTTA | cttaCTGTTAATGGAATCAGCCA | 17841 | BlatCas9 | 78 | 0 |
| 810 | ACTACCTT | atgcCACTGAGAACTCTCTTAAG | 17842 | BlatCas9 | 78 | 0 |
| 811 | AAATC | cttaCTGTTAATGGAATCAGCCA | 17843 | BlatCas9 | 78 | 0 |
| 812 | ACTAC | atgcCACTGAGAACTCTCTTAAG | 17844 | BlatCas9 | 78 | 0 |
| 813 | AAATCTT | TTACTGTTAATGGAATCAGCCA | 17845 | CdiCas9 | 78 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 814 | AAAT | ACTGTTAATGGAATCAGCCA | 17846 | SpyCas9-3var-NRRH | 78 | 0 |
| 815 | AAAT | taCTGTTAATGGAATCAGCCA | 17847 | iSpyMacCas9 | 78 | 0 |
| 816 | AAA | TACTGTTAATGGAATCAGCC | 17848 | SpyCas9-SpRY | 79 | 0 |
| 817 | GAC | GCCACTGAGAACTCTCTTAA | 17849 | SpyCas9-SpRY | 79 | 0 |
| 818 | AAAATCT | CTTACTGTTAATGGAATCAGCC | 17850 | CdiCas9 | 79 | 0 |
| 819 | AAAA | TACTGTTAATGGAATCAGCC | 17851 | SpyCas9-3var-NRRH | 79 | 0 |
| 820 | AAAA | ttACTGTTAATGGAATCAGCC | 17852 | iSpy MacCas9 | 79 | 0 |
| 821 | GACT | GCCACTGAGAACTCTCTTAA | 17853 | SpyCas9-3var-NRCH | 79 | 0 |
| 822 | CAAAA | CTTACTGTTAATGGAATCAGC | 17854 | SauCas9KKH | 80 | 0 |
| 823 | CAAAAT | CTTACTGTTAATGGAATCAGC | 17855 | SauCas9KKH | 80 | 0 |
| 824 | CAAAAT | CTTACTGTTAATGGAATCAGC | 17856 | cCas9-v17 | 80 | 0 |
| 825 | CAAAAT | CTTACTGTTAATGGAATCAGC | 17857 | cCas9-v42 | 80 | 0 |
| 826 | AG | TGCCACTGAGAACTCTCTTA | 17858 | SpyCas9-NG | 80 | 0 |
| 827 | AG | TGCCACTGAGAACTCTCTTA | 17859 | SpyCas9-xCas | 80 | 0 |
| 828 | AG | TGCCACTGAGAACTCTCTTA | 17860 | SpyCas9-xCas-NG | 80 | 0 |
| 829 | CAA | TTACTGTTAATGGAATCAGC | 17861 | SpyCas9-SpRY | 80 | 0 |
| 830 | AGA | TGCCACTGAGAACTCTCTTA | 17862 | SpyCas9-SpG | 80 | 0 |
| 831 | AGA | TGCCACTGAGAACTCTCTTA | 17863 | SpyCas9-SpRY | 80 | 0 |
| 832 | CAAAATC | ACTTACTGTTAATGGAATCAGC | 17864 | CdiCas9 | 80 | 0 |
| 833 | AGACTAC | AATGCCACTGAGAACTCTCTTA | 17865 | CdiCas9 | 80 | 0 |
| 834 | CAAA | TTACTGTTAATGGAATCAGC | 17866 | SpyCas9-3var-NRRH | 80 | 0 |
| 835 | CAAA | ctTACTGTTAATGGAATCAGC | 17867 | iSpyMacCas9 | 80 | 0 |
| 836 | AGAC | TGCCACTGAGAACTCTCTTA | 17868 | SpyCas9-3var-NRRH | 80 | 0 |
| 837 | AGAC | TGCCACTGAGAACTCTCTTA | 17869 | SpyCas9-VQR | 80 | 0 |
| 838 | CCAAA | ACTTACTGTTAATGGAATCAG | 17870 | SauCas9KKH | 81 | 0 |
| 839 | AAG | ATGCCACTGAGAACTCTCTT | 17871 | ScaCas9 | 81 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 840 | AAG | ATGCCACTGAGAACTCTCTT | 17872 | ScaCas9-HiFi-Sc++ | 81 | 0 |
| 841 | AAG | ATGCCACTGAGAACTCTCTT | 17873 | ScaCas9-Sc++ | 81 | 0 |
| 842 | AAG | ATGCCACTGAGAACTCTCTT | 17874 | SpyCas9-SpRY | 81 | 0 |
| 843 | CCA | CTTACTGTTAATGGAATCAG | 17875 | SpyCas9-SpRY | 81 | 0 |
| 844 | AAGAC | aaaaTGCCACTGAGAACTCTCTT | 17876 | BlatCas9 | 81 | 0 |
| 845 | AAGACT | AATGCCACTGAGAACTCTCTT | 17877 | cCas9-v16 | 81 | 0 |
| 846 | AAGACT | AATGCCACTGAGAACTCTCTT | 17878 | cCas9-v21 | 81 | 0 |
| 847 | CCAAAA | CTTACTGTTAATGGAATCAG | 17879 | St1Cas9-MTH17CL396 | 81 | 0 |
| 848 | CCAAAA | ACTTACTGTTAATGGAATCAG | 17880 | cCas9-v17 | 81 | 0 |
| 849 | CCAAAA | ACTTACTGTTAATGGAATCAG | 17881 | cCas9-v42 | 81 | 0 |
| 850 | CCAAAAT | TACTTACTGTTAATGGAATCAG | 17882 | CdiCas9 | 81 | 0 |
| 851 | CCAAAAT | TACTTACTGTTAATGGAATCAG | 17883 | CdiCas9 | 81 | 0 |
| 852 | AAGA | ATGCCACTGAGAACTCTCTT | 17884 | SpyCas9-3var-NRRH | 81 | 0 |
| 853 | GCCAA | TACTTACTGTTAATGGAATCA | 17885 | SauCas9KKH | 82 | 0 |
| 854 | TAAGA | AAATGCCACTGAGAACTCTCT | 17886 | SauCas9KKH | 82 | 0 |
| 855 | TAAG | AAATGCCACTGAGAACTCTCT | 17887 | SauriCas9-KKH | 82 | 0 |
| 856 | TAAG | AATGCCACTGAGAACTCTCT | 17888 | SpyCas9-QQR1 | 82 | 0 |
| 857 | TAAG | aaATGCCACTGAGAACTCTCT | 17889 | iSpyMacCas9 | 82 | 0 |
| 858 | TAA | AATGCCACTGAGAACTCTCT | 17890 | SpyCas9-SpRY | 82 | 0 |
| 859 | GCC | ACTTACTGTTAATGGAATCA | 17891 | SpyCas9-SpRY | 82 | 0 |
| 860 | GCCAAA | TACTTACTGTTAATGGAATCA | 17892 | cCas9-v17 | 82 | 0 |
| 861 | GCCAAA | TACTTACTGTTAATGGAATCA | 17893 | cCas9-v42 | 82 | 0 |
| 862 | TAAGAC | AAATGCCACTGAGAACTCTCT | 17894 | cCas9-v17 | 82 | 0 |
| 863 | TAAGAC | AAATGCCACTGAGAACTCTCT | 17895 | cCas9-v42 | 82 | 0 |
| 864 | TTAAG | AAAATGCCACTGAGAACTCTC | 17896 | SauCas9KKH | 83 | 0 |
| 865 | AG | TACTTACTGTTAATGGAATC | 17897 | SpyCas9-NG | 83 | 0 |
| 866 | AG | TACTTACTGTTAATGGAATC | 17898 | SpyCas9-xCas | 83 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 867 | AG | TACTTACTGTTAATGGAATC | 17899 | SpyCas9-xCas-NG | 83 | 0 |
| 868 | AGC | TACTTACTGTTAATGGAATC | 17900 | SpyCas9-SpG | 83 | 0 |
| 869 | AGC | TACTTACTGTTAATGGAATC | 17901 | SpyCas9-SpRY | 83 | 0 |
| 870 | TTA | AAATGCCACTGAGAACTCTC | 17902 | SpyCas9-SpRY | 83 | 0 |
| 871 | TTAAGA | AAAATGCCACTGAGAACTCTC | 17903 | cCas9-v17 | 83 | 0 |
| 872 | TTAAGA | AAAATGCCACTGAGAACTCTC | 17904 | cCas9-v42 | 83 | 0 |
| 873 | TTAAGACT | agtaAAATGCCACTGAGAACTCTC | 17905 | NmeCas9 | 83 | 0 |
| 874 | AGCC | TACTTACTGTTAATGGAATC | 17906 | SpyCas9-3var-NRCH | 83 | 0 |
| 875 | CTTAA | TAAAATGCCACTGAGAACTCT | 17907 | SauCas9KKH | 84 | 0 |
| 876 | CAG | TTACTTACTGTTAATGGAAT | 17908 | ScaCas9 | 84 | 0 |
| 877 | CAG | TTACTTACTGTTAATGGAAT | 17909 | ScaCas9-HiFi-Sc++ | 84 | 0 |
| 878 | CAG | TTACTTACTGTTAATGGAAT | 17910 | ScaCas9-Sc++ | 84 | 0 |
| 879 | CAG | TTACTTACTGTTAATGGAAT | 17911 | SpyCas9-SpRY | 84 | 0 |
| 880 | CTT | AAAATGCCACTGAGAACTCT | 17912 | SpyCas9-SpRY | 84 | 0 |
| 881 | CAGCCAAA | aaatTACTTACTGTTAATGGAAT | 17913 | BlatCas9 | 84 | 0 |
| 882 | CAGCCAAA | aaatTACTTACTGTTAATGGAAT | 17914 | BlatCas9 | 84 | 0 |
| 883 | CAGCCAAA | aaATTACTTACTGTTAATGGAAT | 17915 | GeoCas9 | 84 | 0 |
| 884 | CAGCC | aaatTACTTACTGTTAATGGAAT | 17916 | BlatCas9 | 84 | 0 |
| 885 | CAGC | TTACTTACTGTTAATGGAAT | 17917 | SpyCas9-3var-NRRH | 84 | 0 |
| 886 | TCAGCC | gtAAATTACTTACTGTTAATGGAA | 17918 | Nme2Cas9 | 85 | 0 |
| 887 | TCAG | AATTACTTACTGTTAATGGAA | 17919 | SauriCas9-KKH | 85 | 0 |
| 888 | TCA | ATTACTTACTGTTAATGGAA | 17920 | SpyCas9-SpRY | 85 | 0 |
| 889 | TCT | TAAAATGCCACTGAGAACTC | 17921 | SpyCas9-SpRY | 85 | 0 |
| 890 | TCAGCCAA | taaaTTACTTACTGTTAATGGAA | 17922 | BlatCas9 | 85 | 0 |
| 891 | TCAGCCAA | taaaTTACTTACTGTTAATGGAA | 17923 | BlatCas9 | 85 | 0 |
| 892 | TCAGC | taaaTTACTTACTGTTAATGGAA | 17924 | BlatCas9 | 85 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 893 | ATCAG | AAATTACTTACTGTTAATGGA | 17925 | SauCas9KKH | 86 | 0 |
| 894 | ATC | AATTACTTACTGTTAATGGA | 17926 | SpyCas9-SpRY | 86 | 0 |
| 895 | CTC | GTAAAATGCCACTGAGAACT | 17927 | SpyCas9-SpRY | 86 | 0 |
| 896 | ATCAGC | AAATTACTTACTGTTAATGGA | 17928 | cCas9-v17 | 86 | 0 |
| 897 | ATCAGC | AAATTACTTACTGTTAATGGA | 17929 | cCas9-v42 | 86 | 0 |
| 898 | AAT | AAATTACTTACTGTTAATGG | 17930 | SpyCas9-SpRY | 87 | 0 |
| 899 | TCT | AGTAAAATGCCACTGAGAAC | 17931 | SpyCas9-SpRY | 87 | 0 |
| 900 | AATC | AAATTACTTACTGTTAATGG | 17932 | SpyCas9-3var-NRTH | 87 | 0 |
| 901 | GAA | TAAATTACTTACTGTTAATG | 17933 | SpyCas9-SpRY | 88 | 0 |
| 902 | GAA | TAAATTACTTACTGTTAATG | 17934 | SpyCas9-xCas | 88 | 0 |
| 903 | CTC | AAGTAAAATGCCACTGAGAA | 17935 | SpyCas9-SpRY | 88 | 0 |
| 904 | CTCTCTTA | aagaAGTAAAATGCCACTGAGAA | 17936 | BlatCas9 | 88 | 0 |
| 905 | GAATC | gtgtAAATTACTTACTGTTAATG | 17937 | BlatCas9 | 88 | 0 |
| 906 | CTCTC | aagaAGTAAAATGCCACTGAGAA | 17938 | BlatCas9 | 88 | 0 |
| 907 | GAAT | TAAATTACTTACTGTTAATG | 17939 | SpyCas9-3var-NRRH | 88 | 0 |
| 908 | GAAT | gtAAATTACTTACTGTTAATG | 17940 | iSpyMacCas9 | 88 | 0 |
| 909 | GG | GTAAATTACTTACTGTTAAT | 17941 | SpyCas9-NG | 89 | 0 |
| 910 | GG | GTAAATTACTTACTGTTAAT | 17942 | SpyCas9-xCas | 89 | 0 |
| 911 | GG | GTAAATTACTTACTGTTAAT | 17943 | SpyCas9-xCas-NG | 89 | 0 |
| 912 | GGA | GTAAATTACTTACTGTTAAT | 17944 | SpyCas9-SpG | 89 | 0 |
| 913 | GGA | GTAAATTACTTACTGTTAAT | 17945 | SpyCas9-SpRY | 89 | 0 |
| 914 | ACT | GAAGTAAAATGCCACTGAGA | 17946 | SpyCas9-SpRY | 89 | 0 |
| 915 | GGAA | GTAAATTACTTACTGTTAAT | 17947 | SpyCas9-3var-NRRH | 89 | 0 |
| 916 | GGAA | GTAAATTACTTACTGTTAAT | 17948 | SpyCas9-VQR | 89 | 0 |
| 917 | TGGAA | agGTGTAAATTACTTACTGTTAA | 17949 | SauCas9 | 90 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 918 | TGGAA | GTGTAAATTACTTACTGTTAA | 17950 | SauCas9KKH | 90 | 0 |
| 919 | TGGAAT | agGTGTAAATTACTTACTGTTAA | 17951 | SauCas9 | 90 | 0 |
| 920 | TGGAAT | GTGTAAATTACTTACTGTTAA | 17952 | SauCas9KKH | 90 | 0 |
| 921 | TGGAAT | GTGTAAATTACTTACTGTTAA | 17953 | cCas9-v17 | 90 | 0 |
| 922 | TGGAAT | GTGTAAATTACTTACTGTTAA | 17954 | cCas9-v42 | 90 | 0 |
| 923 | TGG | TGTAAATTACTTACTGTTAA | 17955 | ScaCas9 | 90 | 0 |
| 924 | TGG | TGTAAATTACTTACTGTTAA | 17956 | ScaCas9-HiFi-Sc++ | 90 | 0 |
| 925 | TGG | TGTAAATTACTTACTGTTAA | 17957 | ScaCas9-Sc++ | 90 | 0 |
| 926 | TGG | TGTAAATTACTTACTGTTAA | 17958 | SpyCas9 | 90 | 0 |
| 927 | TGG | TGTAAATTACTTACTGTTAA | 17959 | SpyCas9-HF1 | 90 | 0 |
| 928 | TGG | TGTAAATTACTTACTGTTAA | 17960 | SpyCas9-SpG | 90 | 0 |
| 929 | TGG | TGTAAATTACTTACTGTTAA | 17961 | SpyCas9-SpRY | 90 | 0 |
| 930 | TG | TGTAAATTACTTACTGTTAA | 17962 | SpyCas9-NG | 90 | 0 |
| 931 | TG | TGTAAATTACTTACTGTTAA | 17963 | SpyCas9-xCas | 90 | 0 |
| 932 | TG | TGTAAATTACTTACTGTTAA | 17964 | SpyCas9-xCas-NG | 90 | 0 |
| 933 | AAC | AGAAGTAAAATGCCACTGAG | 17965 | SpyCas9-SpRY | 90 | 0 |
| 934 | AACTC | aaaaGAAGTAAAATGCCACTGAG | 17966 | BlatCas9 | 90 | 0 |
| 935 | TGGAATC | GGTGTAAATTACTTACTGTTAA | 17967 | CdiCas9 | 90 | 0 |
| 936 | TGGA | TGTAAATTACTTACTGTTAA | 17968 | SpyCas9-3var-NRRH | 90 | 0 |
| 937 | AACT | AGAAGTAAAATGCCACTGAG | 17969 | SpyCas9-3var-NRCH | 90 | 0 |
| 938 | ATGGA | aaGGTGTAAATTACTTACTGTTA | 17970 | SauCas9 | 91 | 0 |
| 939 | ATGGA | GGTGTAAATTACTTACTGTTA | 17971 | SauCas9KKH | 91 | 0 |
| 940 | ATGG | GGTGTAAATTACTTACTGTTA | 17972 | SauriCas9 | 91 | 0 |
| 941 | ATGG | GGTGTAAATTACTTACTGTTA | 17973 | SauriCas9-KKH | 91 | 0 |
| 942 | ATG | GTGTAAATTACTTACTGTTA | 17974 | ScaCas9 | 91 | 0 |
| 943 | ATG | GTGTAAATTACTTACTGTTA | 17975 | ScaCas9-HiFi-Sc++ | 91 | 0 |
| 944 | ATG | GTGTAAATTACTTACTGTTA | 17976 | ScaCas9-Sc++ | 91 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 945 | ATG | GTGTAAATTACTTACTGTTA | 17977 | SpyCas9-SpRY | 91 | 0 |
| 946 | GAA | AAGAAGTAAAATGCCACTGA | 17978 | SpyCas9-SpRY | 91 | 0 |
| 947 | GAA | AAGAAGTAAAATGCCACTGA | 17979 | SpyCas9-xCas | 91 | 0 |
| 948 | ATGGAAT | GTGTAAATTACTTACTGTTA | 17980 | St1Cas9 | 91 | 0 |
| 949 | ATGGAA | GGTGTAAATTACTTACTGTTA | 17981 | cCas9-v17 | 91 | 0 |
| 950 | ATGGAA | GGTGTAAATTACTTACTGTTA | 17982 | cCas9-v42 | 91 | 0 |
| 951 | GAACTCT | AAAAGAAGTAAAATGCCACTGA | 17983 | CdiCas9 | 91 | 0 |
| 952 | GAAC | AAGAAGTAAAATGCCACTGA | 17984 | SpyCas9-3var-NRRH | 91 | 0 |
| 953 | GAAC | aaAGAAGTAAAATGCCACTGA | 17985 | iSpyMacCas9 | 91 | 0 |
| 954 | AATGG | AGGTGTAAATTACTTACTGTT | 17986 | SauCas9KKH | 92 | 0 |
| 955 | AG | AAAGAAGTAAAATGCCACTG | 17987 | SpyCas9-NG | 92 | 0 |
| 956 | AG | AAAGAAGTAAAATGCCACTG | 17988 | SpyCas9-xCas | 92 | 0 |
| 957 | AG | AAAGAAGTAAAATGCCACTG | 17989 | SpyCas9-xCas-NG | 92 | 0 |
| 958 | AAT | GGTGTAAATTACTTACTGTT | 17990 | SpyCas9-SpRY | 92 | 0 |
| 959 | AGA | AAAGAAGTAAAATGCCACTG | 17991 | SpyCas9-SpG | 92 | 0 |
| 960 | AGA | AAAGAAGTAAAATGCCACTG | 17992 | SpyCas9-SpRY | 92 | 0 |
| 961 | AGAAC | aaaaAAGAAGTAAAATGCCACTG | 17993 | BlatCas9 | 92 | 0 |
| 962 | AGAACT | AAAAGAAGTAAAATGCCACTG | 17994 | cCas9-v16 | 92 | 0 |
| 963 | AGAACT | AAAAGAAGTAAAATGCCACTG | 17995 | cCas9-v21 | 92 | 0 |
| 964 | AGAACTC | AAAAAGAAGTAAAATGCCACTG | 17996 | CdiCas9 | 92 | 0 |
| 965 | AGAA | AAAGAAGTAAAATGCCACTG | 17997 | SpyCas9-3var-NRRH | 92 | 0 |
| 966 | AGAA | AAAGAAGTAAAATGCCACTG | 17998 | SpyCas9-VQR | 92 | 0 |
| 967 | GAGAA | taAAAAAGAAGTAAAATGCCACT | 17999 | SauCas9 | 93 | 0 |
| 968 | GAGAA | AAAAAGAAGTAAAATGCCACT | 18000 | SauCas9KKH | 93 | 0 |
| 969 | GAG | AAAAGAAGTAAAATGCCACT | 18001 | ScaCas9 | 93 | 0 |
| 970 | GAG | AAAAGAAGTAAAATGCCACT | 18002 | ScaCas9-HiFi-Sc++ | 93 | 0 |
| 971 | GAG | AAAAGAAGTAAAATGCCACT | 18003 | ScaCas9-Sc++ | 93 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 972 | GAG | AAAAGAAGTAAAATGCCACT | 18004 | SpyCas9-SpRY | 93 | 0 |
| 973 | TAA | AGGTGTAAATTACTTACTGT | 18005 | SpyCas9-SpRY | 93 | 0 |
| 974 | GAGAAC | AAAAAGAAGTAAAATGCCACT | 18006 | cCas9-v17 | 93 | 0 |
| 975 | GAGAAC | AAAAAGAAGTAAAATGCCACT | 18007 | cCas9-v42 | 93 | 0 |
| 976 | GAGAACT | AAAAAAGAAGTAAAATGCCACT | 18008 | CdiCas9 | 93 | 0 |
| 977 | TAAT | AGGTGTAAATTACTTACTGT | 18009 | SpyCas9-3var-NRRH | 93 | 0 |
| 978 | TAAT | aaGGTGTAAATTACTTACTGT | 18010 | iSpyMacCas9 | 93 | 0 |
| 979 | GAGA | AAAAGAAGTAAAATGCCACT | 18011 | SpyCas9-3var-NRRH | 93 | 0 |
| 980 | TGAGA | AAAAAAGAAGTAAAATGCCAC | 18012 | SauCas9KKH | 94 | 0 |
| 981 | TGAG | AAAAAAGAAGTAAAATGCCAC | 18013 | SauriCas9-KKH | 94 | 0 |
| 982 | TGAG | AAAAAGAAGTAAAATGCCAC | 18014 | SpyCas9-VQR | 94 | 0 |
| 983 | TG | AAAAAGAAGTAAAATGCCAC | 18015 | SpyCas9-NG | 94 | 0 |
| 984 | TG | AAAAAGAAGTAAAATGCCAC | 18016 | SpyCas9-xCas | 94 | 0 |
| 985 | TG | AAAAAGAAGTAAAATGCCAC | 18017 | SpyCas9-xCas-NG | 94 | 0 |
| 986 | TGA | AAAAAGAAGTAAAATGCCAC | 18018 | SpyCas9-SpG | 94 | 0 |
| 987 | TGA | AAAAAGAAGTAAAATGCCAC | 18019 | SpyCas9-SpRY | 94 | 0 |
| 988 | TTA | AAGGTGTAAATTACTTACTG | 18020 | SpyCas9-SpRY | 94 | 0 |
| 989 | TGAGAA | AAAAAAGAAGTAAAATGCCAC | 18021 | cCas9-v17 | 94 | 0 |
| 990 | TGAGAA | AAAAAAGAAGTAAAATGCCAC | 18022 | cCas9-v42 | 94 | 0 |
| 991 | CTGAG | ccTAAAAAAGAAGTAAAATGCCA | 18023 | SauCas9 | 95 | 0 |
| 992 | CTGAG | TAAAAAAGAAGTAAAATGCCA | 18024 | SauCas9KKH | 95 | 0 |
| 993 | GTTAA | GTAAGGTGTAAATTACTTACT | 18025 | SauCas9KKH | 95 | 0 |
| 994 | GTTAAT | GTAAGGTGTAAATTACTTACT | 18026 | SauCas9KKH | 95 | 0 |
| 995 | CTG | AAAAAAGAAGTAAAATGCCA | 18027 | ScaCas9 | 95 | 0 |
| 996 | CTG | AAAAAAGAAGTAAAATGCCA | 18028 | ScaCas9-HiFi-Sc++ | 95 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 997 | CTG | AAAAAAGAAGTAAAATGCCA | 18029 | ScaCas9-Sc++ | 95 | 0 |
| 998 | CTG | AAAAAAGAAGTAAAATGCCA | 18030 | SpyCas9-SpRY | 95 | 0 |
| 999 | GTT | TAAGGTGTAAATTACTTACT | 18031 | SpyCas9-SpRY | 95 | 0 |
| 1000 | CTGAGA | TAAAAAAGAAGTAAAATGCCA | 18032 | cCas9-v17 | 95 | 0 |
| 1001 | CTGAGA | TAAAAAAGAAGTAAAATGCCA | 18033 | cCas9-v42 | 95 | 0 |
| 1002 | ACTGA | CTAAAAAAGAAGTAAAATGCC | 18034 | SauCas9KKH | 96 | 0 |
| 1003 | TG | GTAAGGTGTAAATTACTTAC | 18035 | SpyCas9-NG | 96 | 0 |
| 1004 | TG | GTAAGGTGTAAATTACTTAC | 18036 | SpyCas9-xCas | 96 | 0 |
| 1005 | TG | GTAAGGTGTAAATTACTTAC | 18037 | SpyCas9-xCas-NG | 96 | 0 |
| 1006 | TGT | GTAAGGTGTAAATTACTTAC | 18038 | SpyCas9-SpG | 96 | 0 |
| 1007 | TGT | GTAAGGTGTAAATTACTTAC | 18039 | SpyCas9-SpRY | 96 | 0 |
| 1008 | ACT | TAAAAAAGAAGTAAAATGCC | 18040 | SpyCas9-SpRY | 96 | 0 |
| 1009 | TGTT | GTAAGGTGTAAATTACTTAC | 18041 | SpyCas9-3var-NRTH | 96 | 0 |
| 1010 | CTG | CGTAAGGTGTAAATTACTTA | 18042 | ScaCas9 | 97 | 0 |
| 1011 | CTG | CGTAAGGTGTAAATTACTTA | 18043 | ScaCas9-HiFi-Sc++ | 97 | 0 |
| 1012 | CTG | CGTAAGGTGTAAATTACTTA | 18044 | ScaCas9-Sc++ | 97 | 0 |
| 1013 | CTG | CGTAAGGTGTAAATTACTTA | 18045 | SpyCas9-SpRY | 97 | 0 |
| 1014 | CAC | CTAAAAAAGAAGTAAAATGC | 18046 | SpyCas9-SpRY | 97 | 0 |
| 1015 | CACT | CTAAAAAAGAAGTAAAATGC | 18047 | SpyCas9-3var-NRCH | 97 | 0 |
| 1016 | ACT | TCGTAAGGTGTAAATTACTT | 18048 | SpyCas9-SpRY | 98 | 0 |
| 1017 | CCA | CCTAAAAAAGAAGTAAAATG | 18049 | SpyCas9-SpRY | 98 | 0 |
| 1018 | TACTGTT | tggCCTCGTAAGGTGTAAATTACT | 18050 | PpnCas9 | 99 | 0 |
| 1019 | TAC | CTCGTAAGGTGTAAATTACT | 18051 | SpyCas9-SpRY | 99 | 0 |
| 1020 | GCC | TCCTAAAAAAGAAGTAAAAT | 18052 | SpyCas9-SpRY | 99 | 0 |
| 1021 | GCCACTGA | tgttCCTAAAAAAGAAGTAAAAT | 18053 | BlatCas9 | 99 | 0 |

TABLE 1A-continued

Exemplary gRNA spacer Cas pairs for correcting the pathogenic R408W mutation
Table 1A provides a gRNA database for correcting the pathogenic R408W mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2A, 3A, and 4A detail the other components of the system and are organized such that the ID number shown here in Column 1 ("ID") is meant to correspond to the same ID number in Tables 2A, 3A, and 4A.

| ID | PAM sequence | gRNA spacer | SEQ ID NO | Cas species | distance | Overlaps mutation |
|---|---|---|---|---|---|---|
| 1022 | GCCAC | tgttCCTAAAAAAGAAGTAAAAT | 18054 | BlatCas9 | 99 | 0 |
| 1023 | GCCACT | TTCCTAAAAAAGAAGTAAAAT | 18055 | cCas9-v16 | 99 | 0 |
| 1024 | GCCACT | TTCCTAAAAAAGAAGTAAAAT | 18056 | cCas9-v21 | 99 | 0 |
| 1025 | TACT | CTCGTAAGGTGTAAATTACT | 18057 | SpyCas9-3var-NRCH | 99 | 0 |
| 1026 | TG | TTCCTAAAAAAGAAGTAAAA | 18058 | SpyCas9-NG | 100 | 0 |
| 1027 | TG | TTCCTAAAAAAGAAGTAAAA | 18059 | SpyCas9-xCas | 100 | 0 |
| 1028 | TG | TTCCTAAAAAAGAAGTAAAA | 18060 | SpyCas9-xCas-NG | 100 | 0 |
| 1029 | TGC | TTCCTAAAAAAGAAGTAAAA | 18061 | SpyCas9-SpG | 100 | 0 |
| 1030 | TGC | TTCCTAAAAAAGAAGTAAAA | 18062 | SpyCas9-SpRY | 100 | 0 |
| 1031 | TTA | CCTCGTAAGGTGTAAATTAC | 18063 | SpyCas9-SpRY | 100 | 0 |
| 1032 | TGCC | TTCCTAAAAAAGAAGTAAAA | 18064 | SpyCas9-3var-NRCH | 100 | 0 |

TABLE 1B

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 1 | TCTTCC | tcTTGGGTGGCCTGGCCTTCCAAG | 19152 | Nme2Cas9 | 0 | 0 |
| 2 | TCT | GGGTGGCCTGGCCTTCCAAG | 19153 | SpyCas9-SpRY | 0 | 0 |
| 3 | TCTTC | cttgGGTGGCCTGGCCTTCCAAG | 19154 | BlatCas9 | 0 | 0 |
| 4 | GAAGG | CTGTGTGCAGTGGAAGACTTG | 19155 | SauCas9KKH | 1 | 0 |
| 5 | GAAG | CTGTGTGCAGTGGAAGACTTG | 19156 | SauriCas9-KKH | 1 | 0 |
| 6 | GAAG | TGTGTGCAGTGGAAGACTTG | 19157 | SpyCas9-QQR1 | 1 | 0 |
| 7 | GAAG | ctGTGTGCAGTGGAAGACTTG | 19158 | iSpy MacCas9 | 1 | 0 |
| 8 | GAA | TGTGTGCAGTGGAAGACTTG | 19159 | SpyCas9-SpRY | 1 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 9 | GAA | TGTGTGCAGTGGAAGACTTG | 19160 | SpyCas9-xCas | 1 | 0 |
| 10 | GTC | TGGGTGGCCTGGCCTTCCAA | 19161 | SpyCas9-SpRY | 1 | 0 |
| 11 | GAAGGC | CTGTGTGCAGTGGAAGACTTG | 19162 | cCas9-v17 | 1 | 0 |
| 12 | GAAGGC | CTGTGTGCAGTGGAAGACTTG | 19163 | cCas9-v42 | 1 | 0 |
| 13 | GGAAG | ACTGTGTGCAGTGGAAGACTT | 19164 | SauCas9KKH | 2 | 0 |
| 14 | AG | TTGGGTGGCCTGGCCTTCCA | 19165 | SpyCas9-NG | 2 | 0 |
| 15 | AG | TTGGGTGGCCTGGCCTTCCA | 19166 | SpyCas9-xCas | 2 | 0 |
| 16 | AG | TTGGGTGGCCTGGCCTTCCA | 19167 | SpyCas9-xCas-NG | 2 | 0 |
| 17 | GG | CTGTGTGCAGTGGAAGACTT | 19168 | SpyCas9-NG | 2 | 0 |
| 18 | GG | CTGTGTGCAGTGGAAGACTT | 19169 | SpyCas9-xCas | 2 | 0 |
| 19 | GG | CTGTGTGCAGTGGAAGACTT | 19170 | SpyCas9-xCas-NG | 2 | 0 |
| 20 | AGT | TTGGGTGGCCTGGCCTTCCA | 19171 | SpyCas9-SpG | 2 | 0 |
| 21 | AGT | TTGGGTGGCCTGGCCTTCCA | 19172 | SpyCas9-SpRY | 2 | 0 |
| 22 | GGA | CTGTGTGCAGTGGAAGACTT | 19173 | SpyCas9-SpG | 2 | 0 |
| 23 | GGA | CTGTGTGCAGTGGAAGACTT | 19174 | SpyCas9-SpRY | 2 | 0 |
| 24 | GGAAGG | ACTGTGTGCAGTGGAAGACTT | 19175 | cCas9-v17 | 2 | 0 |
| 25 | GGAAGG | ACTGTGTGCAGTGGAAGACTT | 19176 | cCas9-v42 | 2 | 0 |
| 26 | GGAA | CTGTGTGCAGTGGAAGACTT | 19177 | SpyCas9-3var-NRRH | 2 | 0 |
| 27 | GGAA | CTGTGTGCAGTGGAAGACTT | 19178 | SpyCas9-VQR | 2 | 0 |
| 28 | AGTC | TTGGGTGGCCTGGCCTTCCA | 19179 | SpyCas9-3var-NRTH | 2 | 0 |
| 29 | tGGAA | tgTACTGTGTGCAGTGGAAGACT | 19180 | SauCas9 | 3 | 1 |
| 30 | tGGAA | TACTGTGTGCAGTGGAAGACT | 19181 | SauCas9KKH | 3 | 1 |
| 31 | aAG | CTTGGGTGGCCTGGCCTTCC | 19182 | ScaCas9 | 3 | 1 |
| 32 | aAG | CTTGGGTGGCCTGGCCTTCC | 19183 | ScaCas9-HiFi-Sc++ | 3 | 1 |
| 33 | aAG | CTTGGGTGGCCTGGCCTTCC | 19184 | ScaCas9-Sc++ | 3 | 1 |
| 34 | aAG | CTTGGGTGGCCTGGCCTTCC | 19185 | SpyCas9-SpRY | 3 | 1 |
| 35 | tGG | ACTGTGTGCAGTGGAAGACT | 19186 | ScaCas9 | 3 | 1 |
| 36 | tGG | ACTGTGTGCAGTGGAAGACT | 19187 | ScaCas9-HiFi-Sc++ | 3 | 1 |
| 37 | tGG | ACTGTGTGCAGTGGAAGACT | 19188 | ScaCas9-Sc++ | 3 | 1 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 38 | tGG | ACTGTGTGCAGTGGAAGACT | 19189 | SpyCas9 | 3 | 1 |
| 39 | tGG | ACTGTGTGCAGTGGAAGACT | 19190 | SpyCas9-HF1 | 3 | 1 |
| 40 | tGG | ACTGTGTGCAGTGGAAGACT | 19191 | SpyCas9-SpG | 3 | 1 |
| 41 | tGG | ACTGTGTGCAGTGGAAGACT | 19192 | SpyCas9-SpRY | 3 | 1 |
| 42 | tG | ACTGTGTGCAGTGGAAGACT | 19193 | SpyCas9-NG | 3 | 1 |
| 43 | tG | ACTGTGTGCAGTGGAAGACT | 19194 | SpyCas9-xCas | 3 | 1 |
| 44 | tG | ACTGTGTGCAGTGGAAGACT | 19195 | SpyCas9-xCas-NG | 3 | 1 |
| 45 | aAGTC | tttcTTGGGTGGCCTGGCCTTCC | 19196 | BlatCas9 | 3 | 1 |
| 46 | tGGAAG | TACTGTGTGCAGTGGAAGACT | 19197 | cCas9-v17 | 3 | 1 |
| 47 | tGGAAG | TACTGTGTGCAGTGGAAGACT | 19198 | cCas9-v42 | 3 | 1 |
| 48 | aAGTCTT | TTCTTGGGTGGCCTGGCCTTCC | 19199 | CdiCas9 | 3 | 1 |
| 49 | aAGT | CTTGGGTGGCCTGGCCTTCC | 19200 | SpyCas9-3var-NRRH | 3 | 1 |
| 50 | tGGA | ACTGTGTGCAGTGGAAGACT | 19201 | SpyCas9-3var-NRRH | 3 | 1 |
| 51 | TtGGA | atGTACTGTGTGCAGTGGAAGAC | 19202 | SauCas9 | 4 | 1 |
| 52 | TtGGA | GTACTGTGTGCAGTGGAAGAC | 19203 | SauCas9KKH | 4 | 1 |
| 53 | TtGG | GTACTGTGTGCAGTGGAAGAC | 19204 | SauriCas9 | 4 | 1 |
| 54 | TtGG | GTACTGTGTGCAGTGGAAGAC | 19205 | SauriCas9-KKH | 4 | 1 |
| 55 | CaAG | TTCTTGGGTGGCCTGGCCTTC | 19206 | SauriCas9-KKH | 4 | 1 |
| 56 | CaAG | TCTTGGGTGGCCTGGCCTTC | 19207 | SpyCas9-QQR1 | 4 | 1 |
| 57 | CaAG | ttCTTGGGTGGCCTGGCCTTC | 19208 | iSpyMacCas9 | 4 | 1 |
| 58 | TtG | TACTGTGTGCAGTGGAAGAC | 19209 | ScaCas9 | 4 | 1 |
| 59 | TtG | TACTGTGTGCAGTGGAAGAC | 19210 | ScaCas9-HiFi-Sc++ | 4 | 1 |
| 60 | TtG | TACTGTGTGCAGTGGAAGAC | 19211 | ScaCas9-Sc++ | 4 | 1 |
| 61 | TtG | TACTGTGTGCAGTGGAAGAC | 19212 | SpyCas9-SpRY | 4 | 1 |
| 62 | CaA | TCTTGGGTGGCCTGGCCTTC | 19213 | SpyCas9-SpRY | 4 | 1 |
| 63 | TtGGAA | GTACTGTGTGCAGTGGAAGAC | 19214 | cCas9-v17 | 4 | 1 |
| 64 | TtGGAA | GTACTGTGTGCAGTGGAAGAC | 19215 | cCas9-v42 | 4 | 1 |
| 65 | CCaAG | TTTCTTGGGTGGCCTGGCCTT | 19216 | SauCas9KKH | 5 | 1 |
| 66 | CTtGG | TGTACTGTGTGCAGTGGAAGA | 19217 | SauCas9KKH | 5 | 1 |
| 67 | CCaAGT | TTTCTTGGGTGGCCTGGCCTT | 19218 | SauCas9KKH | 5 | 1 |
| 68 | CCaAGT | TTTCTTGGGTGGCCTGGCCTT | 19219 | cCas9-v17 | 5 | 1 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 69 | CCaAGT | TTTCTTGGGTGGCCTGGCCTT | 19220 | cCas9-v42 | 5 | 1 |
| 70 | CTt | GTACTGTGTGCAGTGGAAGA | 19221 | SpyCas9-SpRY | 5 | 1 |
| 71 | CCa | TTCTTGGGTGGCCTGGCCTT | 19222 | SpyCas9-SpRY | 5 | 1 |
| 72 | CCaAGTCT | ggatTTCTTGGGTGGCCTGGCCTT | 19223 | NmeCas9 | 5 | 1 |
| 73 | TCCaA | ATTTCTTGGGTGGCCTGGCCT | 19224 | SauCas9KKH | 6 | 1 |
| 74 | ACT | TGTACTGTGTGCAGTGGAAG | 19225 | SpyCas9-SpRY | 6 | 0 |
| 75 | TCC | TTTCTTGGGTGGCCTGGCCT | 19226 | SpyCas9-SpRY | 6 | 0 |
| 76 | TCCaAG | ATTTCTTGGGTGGCCTGGCCT | 19227 | cCas9-v17 | 6 | 1 |
| 77 | TCCaAG | ATTTCTTGGGTGGCCTGGCCT | 19228 | cCas9-v42 | 6 | 1 |
| 78 | GAC | ATGTACTGTGTGCAGTGGAA | 19229 | SpyCas9-SpRY | 7 | 0 |
| 79 | TTC | ATTTCTTGGGTGGCCTGGCC | 19230 | Spy Cas9-SpRY | 7 | 0 |
| 80 | GACT | ATGTACTGTGTGCAGTGGAA | 19231 | SpyCas9-3var-NRCH | 7 | 0 |
| 81 | AG | GATGTACTGTGTGCAGTGGA | 19232 | Spy Cas9-NG | 8 | 0 |
| 82 | AG | GATGTACTGTGTGCAGTGGA | 19233 | SpyCas9-xCas | 8 | 0 |
| 83 | AG | GATGTACTGTGTGCAGTGGA | 19234 | SpyCas9-xCas-NG | 8 | 0 |
| 84 | AGA | GATGTACTGTGTGCAGTGGA | 19235 | SpyCas9-SpG | 8 | 0 |
| 85 | AGA | GATGTACTGTGTGCAGTGGA | 19236 | SpyCas9-SpRY | 8 | 0 |
| 86 | CTT | GATTTCTTGGGTGGCCTGGC | 19237 | SpyCas9-SpRY | 8 | 0 |
| 87 | CTTCCaAG | cgggATTTCTTGGGTGGCCTGGC | 19238 | BlatCas9 | 8 | 1 |
| 88 | CTTCC | cgggATTTCTTGGGTGGCCTGGC | 19239 | BlatCas9 | 8 | 0 |
| 89 | AGAC | GATGTACTGTGTGCAGTGGA | 19240 | SpyCas9-3var-NRRH | 8 | 0 |
| 90 | AGAC | GATGTACTGTGTGCAGTGGA | 19241 | SpyCas9-VQR | 8 | 0 |
| 91 | CCTTCC | ctCGGGATTTCTTGGGTGGCCTGG | 19242 | Nme2Cas9 | 9 | 0 |
| 92 | AAG | TGATGTACTGTGTGCAGTGG | 19243 | ScaCas9 | 9 | 0 |
| 93 | AAG | TGATGTACTGTGTGCAGTGG | 19244 | ScaCas9-HiFi-Sc++ | 9 | 0 |
| 94 | AAG | TGATGTACTGTGTGCAGTGG | 19245 | ScaCas9-Sc++ | 9 | 0 |
| 95 | AAG | TGATGTACTGTGTGCAGTGG | 19246 | SpyCas9-SpRY | 9 | 0 |
| 96 | CCT | GGATTTCTTGGGTGGCCTGG | 19247 | SpyCas9-SpRY | 9 | 0 |
| 97 | AAGACTtG | gtctGATGTACTGTGTGCAGTGG | 19248 | BlatCas9 | 9 | 1 |
| 98 | CCTTCCaA | tcggGATTTCTTGGGTGGCCTGG | 19249 | BlatCas9 | 9 | 1 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 99 | CCTTCCaA | tcggGATTTCTTGGGTGGCCTGG | 19250 | BlatCas9 | 9 | 1 |
| 100 | AAGAC | gtctGATGTACTGTGTGCAGTGG | 19251 | BlatCas9 | 9 | 0 |
| 101 | CCTTC | tcggGATTTCTTGGGTGGCCTGG | 19252 | BlatCas9 | 9 | 0 |
| 102 | AAGACT | CTGATGTACTGTGTGCAGTGG | 19253 | cCas9-v16 | 9 | 0 |
| 103 | AAGACT | CTGATGTACTGTGTGCAGTGG | 19254 | cCas9-v21 | 9 | 0 |
| 104 | AAGACTt | TCTGATGTACTGTGTGCAGTGG | 19255 | CdiCas9 | 9 | 1 |
| 105 | AAGA | TGATGTACTGTGTGCAGTGG | 19256 | SpyCas9-3var-NRRH | 9 | 0 |
| 106 | GAAGA | TCTGATGTACTGTGTGCAGTG | 19257 | SauCas9KKH | 10 | 0 |
| 107 | GAAG | TCTGATGTACTGTGTGCAGTG | 19258 | SauriCas9-KKH | 10 | 0 |
| 108 | GAAG | CTGATGTACTGTGTGCAGTG | 19259 | SpyCas9-QQR1 | 10 | 0 |
| 109 | GAAG | tcTGATGTACTGTGTGCAGTG | 19260 | iSpyMacCas9 | 10 | 0 |
| 110 | GAA | CTGATGTACTGTGTGCAGTG | 19261 | SpyCas9-SpRY | 10 | 0 |
| 111 | GAA | CTGATGTACTGTGTGCAGTG | 19262 | SpyCas9-xCas | 10 | 0 |
| 112 | GCC | GGGATTTCTTGGGTGGCCTG | 19263 | Spy Cas9-SpRY | 10 | 0 |
| 113 | GAAGAC | TCTGATGTACTGTGTGCAGTG | 19264 | cCas9-v17 | 10 | 0 |
| 114 | GAAGAC | TCTGATGTACTGTGTGCAGTG | 19265 | cCas9-v42 | 10 | 0 |
| 115 | GGAAG | GTCTGATGTACTGTGTGCAGT | 19266 | SauCas9KKH | 11 | 0 |
| 116 | GG | TCTGATGTACTGTGTGCAGT | 19267 | SpyCas9-NG | 11 | 0 |
| 117 | GG | TCTGATGTACTGTGTGCAGT | 19268 | SpyCas9-xCas | 11 | 0 |
| 118 | GG | TCTGATGTACTGTGTGCAGT | 19269 | SpyCas9-xCas-NG | 11 | 0 |
| 119 | GG | CGGGATTTCTTGGGTGGCCT | 19270 | SpyCas9-NG | 11 | 0 |
| 120 | GG | CGGGATTTCTTGGGTGGCCT | 19271 | SpyCas9-xCas | 11 | 0 |
| 121 | GG | CGGGATTTCTTGGGTGGCCT | 19272 | SpyCas9-xCas-NG | 11 | 0 |
| 122 | GGA | TCTGATGTACTGTGTGCAGT | 19273 | SpyCas9-SpG | 11 | 0 |
| 123 | GGA | TCTGATGTACTGTGTGCAGT | 19274 | SpyCas9-SpRY | 11 | 0 |
| 124 | GGC | CGGGATTTCTTGGGTGGCCT | 19275 | SpyCas9-SpG | 11 | 0 |
| 125 | GGC | CGGGATTTCTTGGGTGGCCT | 19276 | Spy Cas9-SpRY | 11 | 0 |
| 126 | GGAAGA | GTCTGATGTACTGTGTGCAGT | 19277 | cCas9-v17 | 11 | 0 |
| 127 | GGAAGA | GTCTGATGTACTGTGTGCAGT | 19278 | cCas9-v42 | 11 | 0 |
| 128 | GGAAGACT | catgTCTGATGTACTGTGTGCAGT | 19279 | NmeCas9 | 11 | 0 |
| 129 | GGAA | TCTGATGTACTGTGTGCAGT | 19280 | SpyCas9-3var-NRRH | 11 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 130 | GGAA | TCTGATGTACTGTGTGCAGT | 19281 | SpyCas9-VQR | 11 | 0 |
| 131 | GGCC | CGGGATTTCTTGGGTGGCCT | 19282 | SpyCas9-3var-NRCH | 11 | 0 |
| 132 | TGGAA | caTGTCTGATGTACTGTGTGCAG | 19283 | SauCas9 | 12 | 0 |
| 133 | TGGAA | TGTCTGATGTACTGTGTGCAG | 19284 | SauCas9KKH | 12 | 0 |
| 134 | TGG | GTCTGATGTACTGTGTGCAG | 19285 | ScaCas9 | 12 | 0 |
| 135 | TGG | GTCTGATGTACTGTGTGCAG | 19286 | ScaCas9-HiFi-Sc++ | 12 | 0 |
| 136 | TGG | GTCTGATGTACTGTGTGCAG | 19287 | ScaCas9-Sc++ | 12 | 0 |
| 137 | TGG | GTCTGATGTACTGTGTGCAG | 19288 | SpyCas9 | 12 | 0 |
| 138 | TGG | GTCTGATGTACTGTGTGCAG | 19289 | SpyCas9-HF1 | 12 | 0 |
| 139 | TGG | GTCTGATGTACTGTGTGCAG | 19290 | SpyCas9-SpG | 12 | 0 |
| 140 | TGG | GTCTGATGTACTGTGTGCAG | 19291 | SpyCas9-SpRY | 12 | 0 |
| 141 | TGG | TCGGGATTTCTTGGGTGGCC | 19292 | ScaCas9 | 12 | 0 |
| 142 | TGG | TCGGGATTTCTTGGGTGGCC | 19293 | ScaCas9-HiFi-Sc++ | 12 | 0 |
| 143 | TGG | TCGGGATTTCTTGGGTGGCC | 19294 | ScaCas9-Sc++ | 12 | 0 |
| 144 | TGG | TCGGGATTTCTTGGGTGGCC | 19295 | SpyCas9 | 12 | 0 |
| 145 | TGG | TCGGGATTTCTTGGGTGGCC | 19296 | SpyCas9-HF1 | 12 | 0 |
| 146 | TGG | TCGGGATTTCTTGGGTGGCC | 19297 | SpyCas9-SpG | 12 | 0 |
| 147 | TGG | TCGGGATTTCTTGGGTGGCC | 19298 | SpyCas9-SpRY | 12 | 0 |
| 148 | TG | GTCTGATGTACTGTGTGCAG | 19299 | SpyCas9-NG | 12 | 0 |
| 149 | TG | GTCTGATGTACTGTGTGCAG | 19300 | SpyCas9-xCas | 12 | 0 |
| 150 | TG | GTCTGATGTACTGTGTGCAG | 19301 | SpyCas9-xCas-NG | 12 | 0 |
| 151 | TG | TCGGGATTTCTTGGGTGGCC | 19302 | SpyCas9-NG | 12 | 0 |
| 152 | TG | TCGGGATTTCTTGGGTGGCC | 19303 | SpyCas9-xCas | 12 | 0 |
| 153 | TG | TCGGGATTTCTTGGGTGGCC | 19304 | SpyCas9-xCas-NG | 12 | 0 |
| 154 | TGGCC | ctctCGGGATTTCTTGGGTGGCC | 19305 | BlatCas9 | 12 | 0 |
| 155 | TGGAAG | TGTCTGATGTACTGTGTGCAG | 19306 | cCas9-v17 | 12 | 0 |
| 156 | TGGAAG | TGTCTGATGTACTGTGTGCAG | 19307 | cCas9-v42 | 12 | 0 |
| 157 | TGGCCTT | TCTCGGGATTTCTTGGGTGGCC | 19308 | CdiCas9 | 12 | 0 |
| 158 | TGGA | GTCTGATGTACTGTGTGCAG | 19309 | SpyCas9-3var-NRRH | 12 | 0 |
| 159 | TGGC | TCGGGATTTCTTGGGTGGCC | 19310 | SpyCas9-3var-NRRH | 12 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 160 | CTGGCC | tcCTCTCGGGATTTCTTGGGTGGC | 19311 | Nme2Cas9 | 13 | 0 |
| 161 | GTGGA | ccATGTCTGATGTACTGTGTGCA | 19312 | SauCas9 | 13 | 0 |
| 162 | GTGGA | ATGTCTGATGTACTGTGTGCA | 19313 | SauCas9KKH | 13 | 0 |
| 163 | GTGG | ATGTCTGATGTACTGTGTGCA | 19314 | SauriCas9 | 13 | 0 |
| 164 | GTGG | ATGTCTGATGTACTGTGTGCA | 19315 | SauriCas9-KKH | 13 | 0 |
| 165 | CTGG | TCTCGGGATTTCTTGGGTGGC | 19316 | SauriCas9 | 13 | 0 |
| 166 | CTGG | TCTCGGGATTTCTTGGGTGGC | 19317 | SauriCas9-KKH | 13 | 0 |
| 167 | GTG | TGTCTGATGTACTGTGTGCA | 19318 | ScaCas9 | 13 | 0 |
| 168 | GTG | TGTCTGATGTACTGTGTGCA | 19319 | ScaCas9-HiFi-Sc++ | 13 | 0 |
| 169 | GTG | TGTCTGATGTACTGTGTGCA | 19320 | ScaCas9-Sc++ | 13 | 0 |
| 170 | GTG | TGTCTGATGTACTGTGTGCA | 19321 | SpyCas9-SpRY | 13 | 0 |
| 171 | CTG | CTCGGGATTTCTTGGGTGGC | 19322 | ScaCas9 | 13 | 0 |
| 172 | CTG | CTCGGGATTTCTTGGGTGGC | 19323 | ScaCas9-HiFi-Sc++ | 13 | 0 |
| 173 | CTG | CTCGGGATTTCTTGGGTGGC | 19324 | ScaCas9-Sc++ | 13 | 0 |
| 174 | CTG | CTCGGGATTTCTTGGGTGGC | 19325 | SpyCas9-SpRY | 13 | 0 |
| 175 | CTGGCCTT | cctcTCGGGATTTCTTGGGTGGC | 19326 | BlatCas9 | 13 | 0 |
| 176 | CTGGC | cctcTCGGGATTTCTTGGGTGGC | 19327 | BlatCas9 | 13 | 0 |
| 177 | GTGGAA | ATGTCTGATGTACTGTGTGCA | 19328 | cCas9-v17 | 13 | 0 |
| 178 | GTGGAA | ATGTCTGATGTACTGTGTGCA | 19329 | cCas9-v42 | 13 | 0 |
| 179 | AGTGG | CATGTCTGATGTACTGTGTGC | 19330 | SauCas9KKH | 14 | 0 |
| 180 | CCTGG | CTCTCGGGATTTCTTGGGTGG | 19331 | SauCas9KKH | 14 | 0 |
| 181 | AG | ATGTCTGATGTACTGTGTGC | 19332 | SpyCas9-NG | 14 | 0 |
| 182 | AG | ATGTCTGATGTACTGTGTGC | 19333 | SpyCas9-xCas | 14 | 0 |
| 183 | AG | ATGTCTGATGTACTGTGTGC | 19334 | SpyCas9-xCas-NG | 14 | 0 |
| 184 | AGT | ATGTCTGATGTACTGTGTGC | 19335 | SpyCas9-SpG | 14 | 0 |
| 185 | AGT | ATGTCTGATGTACTGTGTGC | 19336 | SpyCas9-SpRY | 14 | 0 |
| 186 | CCT | TCTCGGGATTTCTTGGGTGG | 19337 | Spy Cas9-SpRY | 14 | 0 |
| 187 | CAG | CATGTCTGATGTACTGTGTG | 19338 | ScaCas9 | 15 | 0 |
| 188 | CAG | CATGTCTGATGTACTGTGTG | 19339 | ScaCas9-HiFi-Sc++ | 15 | 0 |
| 189 | CAG | CATGTCTGATGTACTGTGTG | 19340 | ScaCas9-Sc++ | 15 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 190 | CAG | CATGTCTGATGTACTGTGTG | 19341 | SpyCas9-SpRY | 15 | 0 |
| 191 | GCC | CTCTCGGGATTTCTTGGGTG | 19342 | SpyCas9-SpRY | 15 | 0 |
| 192 | CAGT | CATGTCTGATGTACTGTGTG | 19343 | SpyCas9-3var-NRRH | 15 | 0 |
| 193 | GCAG | TCCATGTCTGATGTACTGTGT | 19344 | SauriCas9-KKH | 16 | 0 |
| 194 | GG | CCTCTCGGGATTTCTTGGGT | 19345 | SpyCas9-NG | 16 | 0 |
| 195 | GG | CCTCTCGGGATTTCTTGGGT | 19346 | SpyCas9-xCas | 16 | 0 |
| 196 | GG | CCTCTCGGGATTTCTTGGGT | 19347 | SpyCas9-xCas-NG | 16 | 0 |
| 197 | GGC | CCTCTCGGGATTTCTTGGGT | 19348 | SpyCas9-SpG | 16 | 0 |
| 198 | GGC | CCTCTCGGGATTTCTTGGGT | 19349 | SpyCas9-SpRY | 16 | 0 |
| 199 | GCA | CCATGTCTGATGTACTGTGT | 19350 | SpyCas9-SpRY | 16 | 0 |
| 200 | GCAGTG | TCCATGTCTGATGTACTGTGT | 19351 | cCas9-v16 | 16 | 0 |
| 201 | GCAGTG | TCCATGTCTGATGTACTGTGT | 19352 | cCas9-v21 | 16 | 0 |
| 202 | GGCC | CCTCTCGGGATTTCTTGGGT | 19353 | SpyCas9-3var-NRCH | 16 | 0 |
| 203 | TGCAG | ATCCATGTCTGATGTACTGTG | 19354 | SauCas9KKH | 17 | 0 |
| 204 | TGCAGT | ATCCATGTCTGATGTACTGTG | 19355 | SauCas9KKH | 17 | 0 |
| 205 | TGCAGT | ATCCATGTCTGATGTACTGTG | 19356 | cCas9-v17 | 17 | 0 |
| 206 | TGCAGT | ATCCATGTCTGATGTACTGTG | 19357 | cCas9-v42 | 17 | 0 |
| 207 | TGG | TCCTCTCGGGATTTCTTGGG | 19358 | ScaCas9 | 17 | 0 |
| 208 | TGG | TCCTCTCGGGATTTCTTGGG | 19359 | ScaCas9-HiFi-Sc++ | 17 | 0 |
| 209 | TGG | TCCTCTCGGGATTTCTTGGG | 19360 | ScaCas9-Sc++ | 17 | 0 |
| 210 | TGG | TCCTCTCGGGATTTCTTGGG | 19361 | SpyCas9 | 17 | 0 |
| 211 | TGG | TCCTCTCGGGATTTCTTGGG | 19362 | SpyCas9-HF1 | 17 | 0 |
| 212 | TGG | TCCTCTCGGGATTTCTTGGG | 19363 | Spy Cas9-SpG | 17 | 0 |
| 213 | TGG | TCCTCTCGGGATTTCTTGGG | 19364 | SpyCas9-SpRY | 17 | 0 |
| 214 | TG | TCCATGTCTGATGTACTGTG | 19365 | SpyCas9-NG | 17 | 0 |
| 215 | TG | TCCATGTCTGATGTACTGTG | 19366 | SpyCas9-xCas | 17 | 0 |
| 216 | TG | TCCATGTCTGATGTACTGTG | 19367 | SpyCas9-xCas-NG | 17 | 0 |
| 217 | TG | TCCTCTCGGGATTTCTTGGG | 19368 | SpyCas9-NG | 17 | 0 |
| 218 | TG | TCCTCTCGGGATTTCTTGGG | 19369 | SpyCas9-xCas | 17 | 0 |
| 219 | TG | TCCTCTCGGGATTTCTTGGG | 19370 | SpyCas9-xCas-NG | 17 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 220 | TGC | TCCATGTCTGATGTACTGTG | 19371 | SpyCas9-SpG | 17 | 0 |
| 221 | TGC | TCCATGTCTGATGTACTGTG | 19372 | SpyCas9-SpRY | 17 | 0 |
| 222 | TGGCCTGG | ctttCCTCTCGGGATTTCTTGGG | 19373 | BlatCas9 | 17 | 0 |
| 223 | TGGCC | ctttCCTCTCGGGATTTCTTGGG | 19374 | BlatCas9 | 17 | 0 |
| 224 | TGGC | TCCTCTCGGGATTTCTTGGG | 19375 | SpyCas9-3var-NRRH | 17 | 0 |
| 225 | TGCA | TCCATGTCTGATGTACTGTG | 19376 | SpyCas9-3var-NRCH | 17 | 0 |
| 226 | GTGGCC | tgCTTTCCTCTCGGGATTTCTTGG | 19377 | Nme2Cas9 | 18 | 0 |
| 227 | GTGG | TTTCCTCTCGGGATTTCTTGG | 19378 | SauriCas9 | 18 | 0 |
| 228 | GTGG | TTTCCTCTCGGGATTTCTTGG | 19379 | SauriCas9-KKH | 18 | 0 |
| 229 | GTG | ATCCATGTCTGATGTACTGT | 19380 | ScaCas9 | 18 | 0 |
| 230 | GTG | ATCCATGTCTGATGTACTGT | 19381 | ScaCas9-HiFi-Sc++ | 18 | 0 |
| 231 | GTG | ATCCATGTCTGATGTACTGT | 19382 | ScaCas9-Sc++ | 18 | 0 |
| 232 | GTG | ATCCATGTCTGATGTACTGT | 19383 | SpyCas9-SpRY | 18 | 0 |
| 233 | GTG | TTCCTCTCGGGATTTCTTGG | 19384 | ScaCas9 | 18 | 0 |
| 234 | GTG | TTCCTCTCGGGATTTCTTGG | 19385 | ScaCas9-HiFi-Sc++ | 18 | 0 |
| 235 | GTG | TTCCTCTCGGGATTTCTTGG | 19386 | ScaCas9-Sc++ | 18 | 0 |
| 236 | GTG | TTCCTCTCGGGATTTCTTGG | 19387 | SpyCas9-SpRY | 18 | 0 |
| 237 | GTGGCCTG | gcttTCCTCTCGGGATTTCTTGG | 19388 | BlatCas9 | 18 | 0 |
| 238 | GTGGC | gcttTCCTCTCGGGATTTCTTGG | 19389 | BlatCas9 | 18 | 0 |
| 239 | GGTGG | CTTTCCTCTCGGGATTTCTTG | 19390 | SauCas9KKH | 19 | 0 |
| 240 | TG | GATCCATGTCTGATGTACTG | 19391 | SpyCas9-NG | 19 | 0 |
| 241 | TG | GATCCATGTCTGATGTACTG | 19392 | SpyCas9-xCas | 19 | 0 |
| 242 | TG | GATCCATGTCTGATGTACTG | 19393 | SpyCas9-xCas-NG | 19 | 0 |
| 243 | GG | TTTCCTCTCGGGATTTCTTG | 19394 | SpyCas9-NG | 19 | 0 |
| 244 | GG | TTTCCTCTCGGGATTTCTTG | 19395 | SpyCas9-xCas | 19 | 0 |
| 245 | GG | TTTCCTCTCGGGATTTCTTG | 19396 | SpyCas9-xCas-NG | 19 | 0 |
| 246 | TGT | GATCCATGTCTGATGTACTG | 19397 | SpyCas9-SpG | 19 | 0 |
| 247 | TGT | GATCCATGTCTGATGTACTG | 19398 | SpyCas9-SpRY | 19 | 0 |
| 248 | GGT | TTTCCTCTCGGGATTTCTTG | 19399 | SpyCas9-SpG | 19 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 249 | GGT | TTTCCTCTCGGGATTTCTTG | 19400 | SpyCas9-SpRY | 19 | 0 |
| 250 | TGTGCAG T | ttggATCCATGTCTGATGTACTG | 19401 | BlatCas9 | 19 | 0 |
| 251 | TGTGC | ttggATCCATGTCTGATGTACTG | 19402 | BlatCas9 | 19 | 0 |
| 252 | GTG | GGATCCATGTCTGATGTACT | 19403 | ScaCas9 | 20 | 0 |
| 253 | GTG | GGATCCATGTCTGATGTACT | 19404 | ScaCas9-HiFi-Sc++ | 20 | 0 |
| 254 | GTG | GGATCCATGTCTGATGTACT | 19405 | ScaCas9-Sc++ | 20 | 0 |
| 255 | GTG | GGATCCATGTCTGATGTACT | 19406 | SpyCas9-SpRY | 20 | 0 |
| 256 | GGG | CTTTCCTCTCGGGATTTCTT | 19407 | ScaCas9 | 20 | 0 |
| 257 | GGG | CTTTCCTCTCGGGATTTCTT | 19408 | ScaCas9-HiFi-Sc++ | 20 | 0 |
| 258 | GGG | CTTTCCTCTCGGGATTTCTT | 19409 | ScaCas9-Sc++ | 20 | 0 |
| 259 | GGG | CTTTCCTCTCGGGATTTCTT | 19410 | SpyCas9 | 20 | 0 |
| 260 | GGG | CTTTCCTCTCGGGATTTCTT | 19411 | SpyCas9-HF1 | 20 | 0 |
| 261 | GGG | CTTTCCTCTCGGGATTTCTT | 19412 | SpyCas9-SpG | 20 | 0 |
| 262 | GGG | CTTTCCTCTCGGGATTTCTT | 19413 | Spy Cas9-SpRY | 20 | 0 |
| 263 | GG | CTTTCCTCTCGGGATTTCTT | 19414 | SpyCas9-NG | 20 | 0 |
| 264 | GG | CTTTCCTCTCGGGATTTCTT | 19415 | SpyCas9-xCas | 20 | 0 |
| 265 | GG | CTTTCCTCTCGGGATTTCTT | 19416 | SpyCas9-xCas-NG | 20 | 0 |
| 266 | GGGT | CTTTCCTCTCGGGATTTCTT | 19417 | SpyCas9-3var-NRRH | 20 | 0 |
| 267 | TGGG | TGCTTTCCTCTCGGGATTTCT | 19418 | SauriCas9 | 21 | 0 |
| 268 | TGGG | TGCTTTCCTCTCGGGATTTCT | 19419 | SauriCas9-KKH | 21 | 0 |
| 269 | TGG | GCTTTCCTCTCGGGATTTCT | 19420 | ScaCas9 | 21 | 0 |
| 270 | TGG | GCTTTCCTCTCGGGATTTCT | 19421 | ScaCas9-HiFi-Sc++ | 21 | 0 |
| 271 | TGG | GCTTTCCTCTCGGGATTTCT | 19422 | ScaCas9-Sc++ | 21 | 0 |
| 272 | TGG | GCTTTCCTCTCGGGATTTCT | 19423 | SpyCas9 | 21 | 0 |
| 273 | TGG | GCTTTCCTCTCGGGATTTCT | 19424 | SpyCas9-HF1 | 21 | 0 |
| 274 | TGG | GCTTTCCTCTCGGGATTTCT | 19425 | SpyCas9-SpG | 21 | 0 |
| 275 | TGG | GCTTTCCTCTCGGGATTTCT | 19426 | SpyCas9-SpRY | 21 | 0 |
| 276 | TG | TGGATCCATGTCTGATGTAC | 19427 | SpyCas9-NG | 21 | 0 |
| 277 | TG | TGGATCCATGTCTGATGTAC | 19428 | SpyCas9-xCas | 21 | 0 |
| 278 | TG | TGGATCCATGTCTGATGTAC | 19429 | SpyCas9-xCas-NG | 21 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 279 | TG | GCTTTCCTCTCGGGATTTCT | 19430 | SpyCas9-NG | 21 | 0 |
| 280 | TG | GCTTTCCTCTCGGGATTTCT | 19431 | SpyCas9-xCas | 21 | 0 |
| 281 | TG | GCTTTCCTCTCGGGATTTCT | 19432 | SpyCas9-xCas-NG | 21 | 0 |
| 282 | TGT | TGGATCCATGTCTGATGTAC | 19433 | SpyCas9-SpG | 21 | 0 |
| 283 | TGT | TGGATCCATGTCTGATGTAC | 19434 | SpyCas9-SpRY | 21 | 0 |
| 284 | TGGGTG | TGCTTTCCTCTCGGGATTTCT | 19435 | cCas9-v16 | 21 | 0 |
| 285 | TGGGTG | TGCTTTCCTCTCGGGATTTCT | 19436 | cCas9-v21 | 21 | 0 |
| 286 | TTGGG | gcCTGCTTTCCTCTCGGGATTTC | 19437 | SauCas9 | 22 | 0 |
| 287 | TTGGG | CTGCTTTCCTCTCGGGATTTC | 19438 | SauCas9KKH | 22 | 0 |
| 288 | TTGGGT | gcCTGCTTTCCTCTCGGGATTTC | 19439 | SauCas9 | 22 | 0 |
| 289 | TTGGGT | CTGCTTTCCTCTCGGGATTTC | 19440 | SauCas9KKH | 22 | 0 |
| 290 | TTGGGT | CTGCTTTCCTCTCGGGATTTC | 19441 | cCas9-v17 | 22 | 0 |
| 291 | TTGGGT | CTGCTTTCCTCTCGGGATTTC | 19442 | cCas9-v42 | 22 | 0 |
| 292 | TTGG | CTGCTTTCCTCTCGGGATTTC | 19443 | SauriCas9 | 22 | 0 |
| 293 | TTGG | CTGCTTTCCTCTCGGGATTTC | 19444 | SauriCas9-KKH | 22 | 0 |
| 294 | CTG | TTGGATCCATGTCTGATGTA | 19445 | ScaCas9 | 22 | 0 |
| 295 | CTG | TTGGATCCATGTCTGATGTA | 19446 | ScaCas9-HiFi-Sc++ | 22 | 0 |
| 296 | CTG | TTGGATCCATGTCTGATGTA | 19447 | ScaCas9-Sc++ | 22 | 0 |
| 297 | CTG | TTGGATCCATGTCTGATGTA | 19448 | SpyCas9-SpRY | 22 | 0 |
| 298 | TTG | TGCTTTCCTCTCGGGATTTC | 19449 | ScaCas9 | 22 | 0 |
| 299 | TTG | TGCTTTCCTCTCGGGATTTC | 19450 | ScaCas9-HiFi-Sc++ | 22 | 0 |
| 300 | TTG | TGCTTTCCTCTCGGGATTTC | 19451 | ScaCas9-Sc++ | 22 | 0 |
| 301 | TTG | TGCTTTCCTCTCGGGATTTC | 19452 | SpyCas9-SpRY | 22 | 0 |
| 302 | CTTGG | CCTGCTTTCCTCTCGGGATTT | 19453 | SauCas9KKH | 23 | 0 |
| 303 | ACT | CTTGGATCCATGTCTGATGT | 19454 | SpyCas9-SpRY | 23 | 0 |
| 304 | CTT | CTGCTTTCCTCTCGGGATTT | 19455 | Spy Cas9-SpRY | 23 | 0 |
| 305 | TAC | GCTTGGATCCATGTCTGATG | 19456 | SpyCas9-SpRY | 24 | 0 |
| 306 | TCT | CCTGCTTTCCTCTCGGGATT | 19457 | SpyCas9-SpRY | 24 | 0 |
| 307 | TACT | GCTTGGATCCATGTCTGATG | 19458 | SpyCas9-3var-NRCH | 24 | 0 |
| 308 | GTA | GGCTTGGATCCATGTCTGAT | 19459 | SpyCas9-SpRY | 25 | 0 |
| 309 | TTC | GCCTGCTTTCCTCTCGGGAT | 19460 | SpyCas9-SpRY | 25 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 310 | TG | GGGCTTGGATCCATGTCTGA | 19461 | SpyCas9-NG | 26 | 0 |
| 311 | TG | GGGCTTGGATCCATGTCTGA | 19462 | SpyCas9-xCas | 26 | 0 |
| 312 | TG | GGGCTTGGATCCATGTCTGA | 19463 | SpyCas9-xCas-NG | 26 | 0 |
| 313 | TGT | GGGCTTGGATCCATGTCTGA | 19464 | SpyCas9-SpG | 26 | 0 |
| 314 | TGT | GGGCTTGGATCCATGTCTGA | 19465 | Spy Cas9-SpRY | 26 | 0 |
| 315 | TTT | GGCCTGCTTTCCTCTCGGGA | 19466 | SpyCas9-SpRY | 26 | 0 |
| 316 | TGTACTGT | catgGGCTTGGATCCATGTCTGA | 19467 | BlatCas9 | 26 | 0 |
| 317 | TGTAC | catgGGCTTGGATCCATGTCTGA | 19468 | BlatCas9 | 26 | 0 |
| 318 | TGTA | GGGCTTGGATCCATGTCTGA | 19469 | SpyCas9-3var-NRTH | 26 | 0 |
| 319 | ATG | TGGGCTTGGATCCATGTCTG | 19470 | ScaCas9 | 27 | 0 |
| 320 | ATG | TGGGCTTGGATCCATGTCTG | 19471 | ScaCas9-HiFi-Sc++ | 27 | 0 |
| 321 | ATG | TGGGCTTGGATCCATGTCTG | 19472 | ScaCas9-Sc++ | 27 | 0 |
| 322 | ATG | TGGGCTTGGATCCATGTCTG | 19473 | SpyCas9-SpRY | 27 | 0 |
| 323 | ATT | TGGCCTGCTTTCCTCTCGGG | 19474 | SpyCas9-SpRY | 27 | 0 |
| 324 | ATTTCTTG | ggctGGCCTGCTTTCCTCTCGGG | 19475 | BlatCas9 | 27 | 0 |
| 325 | ATTTC | ggctGGCCTGCTTTCCTCTCGGG | 19476 | BlatCas9 | 27 | 0 |
| 326 | ATGTACT | CATGGGCTTGGATCCATGTCTG | 19477 | CdiCas9 | 27 | 0 |
| 327 | GAT | ATGGGCTTGGATCCATGTCT | 19478 | SpyCas9-SpRY | 28 | 0 |
| 328 | GAT | ATGGGCTTGGATCCATGTCT | 19479 | SpyCas9-xCas | 28 | 0 |
| 329 | GAT | CTGGCCTGCTTTCCTCTCGG | 19480 | SpyCas9-SpRY | 28 | 0 |
| 330 | GAT | CTGGCCTGCTTTCCTCTCGG | 19481 | SpyCas9-xCas | 28 | 0 |
| 331 | GATT | CTGGCCTGCTTTCCTCTCGG | 19482 | SpyCas9-3var-NRTH | 28 | 0 |
| 332 | TG | CATGGGCTTGGATCCATGTC | 19483 | SpyCas9-NG | 29 | 0 |
| 333 | TG | CATGGGCTTGGATCCATGTC | 19484 | SpyCas9-xCas | 29 | 0 |
| 334 | TG | CATGGGCTTGGATCCATGTC | 19485 | SpyCas9-xCas-NG | 29 | 0 |
| 335 | GG | GCTGGCCTGCTTTCCTCTCG | 19486 | SpyCas9-NG | 29 | 0 |
| 336 | GG | GCTGGCCTGCTTTCCTCTCG | 19487 | SpyCas9-xCas | 29 | 0 |
| 337 | GG | GCTGGCCTGCTTTCCTCTCG | 19488 | SpyCas9-xCas-NG | 29 | 0 |
| 338 | TGA | CATGGGCTTGGATCCATGTC | 19489 | SpyCas9-SpG | 29 | 0 |
| 339 | TGA | CATGGGCTTGGATCCATGTC | 19490 | SpyCas9-SpRY | 29 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 340 | GGA | GCTGGCCTGCTTTCCTCTCG | 19491 | SpyCas9-SpG | 29 | 0 |
| 341 | GGA | GCTGGCCTGCTTTCCTCTCG | 19492 | SpyCas9-SpRY | 29 | 0 |
| 342 | GGATTTC | TGGCTGGCCTGCTTTCCTCTCG | 19493 | CdiCas9 | 29 | 0 |
| 343 | TGATGTAC | atACATGGGCTTGGATCCATGTC | 19494 | CjeCas9 | 29 | 0 |
| 344 | TGAT | CATGGGCTTGGATCCATGTC | 19495 | SpyCas9-3var-NRRH | 29 | 0 |
| 345 | TGAT | CATGGGCTTGGATCCATGTC | 19496 | SpyCas9-VQR | 29 | 0 |
| 346 | GGAT | GCTGGCCTGCTTTCCTCTCG | 19497 | SpyCas9-3var-NRRH | 29 | 0 |
| 347 | GGAT | GCTGGCCTGCTTTCCTCTCG | 19498 | SpyCas9-VQR | 29 | 0 |
| 348 | CTG | ACATGGGCTTGGATCCATGT | 19499 | ScaCas9 | 30 | 0 |
| 349 | CTG | ACATGGGCTTGGATCCATGT | 19500 | ScaCas9-HiFi-Sc++ | 30 | 0 |
| 350 | CTG | ACATGGGCTTGGATCCATGT | 19501 | ScaCas9-Sc++ | 30 | 0 |
| 351 | CTG | ACATGGGCTTGGATCCATGT | 19502 | SpyCas9-SpRY | 30 | 0 |
| 352 | GGG | GGCTGGCCTGCTTTCCTCTC | 19503 | ScaCas9 | 30 | 0 |
| 353 | GGG | GGCTGGCCTGCTTTCCTCTC | 19504 | ScaCas9-HiFi-Sc++ | 30 | 0 |
| 354 | GGG | GGCTGGCCTGCTTTCCTCTC | 19505 | ScaCas9-Sc++ | 30 | 0 |
| 355 | GGG | GGCTGGCCTGCTTTCCTCTC | 19506 | SpyCas9 | 30 | 0 |
| 356 | GGG | GGCTGGCCTGCTTTCCTCTC | 19507 | SpyCas9-HF1 | 30 | 0 |
| 357 | GGG | GGCTGGCCTGCTTTCCTCTC | 19508 | SpyCas9-SpG | 30 | 0 |
| 358 | GGG | GGCTGGCCTGCTTTCCTCTC | 19509 | SpyCas9-SpRY | 30 | 0 |
| 359 | GG | GGCTGGCCTGCTTTCCTCTC | 19510 | SpyCas9-NG | 30 | 0 |
| 360 | GG | GGCTGGCCTGCTTTCCTCTC | 19511 | SpyCas9-xCas | 30 | 0 |
| 361 | GG | GGCTGGCCTGCTTTCCTCTC | 19512 | SpyCas9-xCas-NG | 30 | 0 |
| 362 | GGGATT | TGGCTGGCCTGCTTTCCTCTC | 19513 | cCas9-v16 | 30 | 0 |
| 363 | GGGATT | TGGCTGGCCTGCTTTCCTCTC | 19514 | cCas9-v21 | 30 | 0 |
| 364 | GGGATTT | GTGGCTGGCCTGCTTTCCTCTC | 19515 | CdiCas9 | 30 | 0 |
| 365 | GGGA | GGCTGGCCTGCTTTCCTCTC | 19516 | SpyCas9-3var-NRRH | 30 | 0 |
| 366 | CGGGATT | cctGTGGCTGGCCTGCTTTCCTCT | 19517 | PpnCas9 | 31 | 0 |
| 367 | CGGGA | ctGTGGCTGGCCTGCTTTCCTCT | 19518 | SauCas9 | 31 | 0 |
| 368 | CGGGA | GTGGCTGGCCTGCTTTCCTCT | 19519 | SauCas9KKH | 31 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 369 | CGGGAT | ctGTGGCTGGCCTGCTTTCCTCT | 19520 | SauCas9 | 31 | 0 |
| 370 | CGGGAT | GTGGCTGGCCTGCTTTCCTCT | 19521 | SauCas9KKH | 31 | 0 |
| 371 | CGGGAT | GTGGCTGGCCTGCTTTCCTCT | 19522 | cCas9-v17 | 31 | 0 |
| 372 | CGGGAT | GTGGCTGGCCTGCTTTCCTCT | 19523 | cCas9-v42 | 31 | 0 |
| 373 | TCTGA | ATACATGGGCTTGGATCCATG | 19524 | SauCas9KKH | 31 | 0 |
| 374 | TCTGAT | ATACATGGGCTTGGATCCATG | 19525 | SauCas9KKH | 31 | 0 |
| 375 | CGGG | GTGGCTGGCCTGCTTTCCTCT | 19526 | SauriCas9 | 31 | 0 |
| 376 | CGGG | GTGGCTGGCCTGCTTTCCTCT | 19527 | SauriCas9-KKH | 31 | 0 |
| 377 | CGG | TGGCTGGCCTGCTTTCCTCT | 19528 | ScaCas9 | 31 | 0 |
| 378 | CGG | TGGCTGGCCTGCTTTCCTCT | 19529 | ScaCas9-HiFi-Sc++ | 31 | 0 |
| 379 | CGG | TGGCTGGCCTGCTTTCCTCT | 19530 | ScaCas9-Sc++ | 31 | 0 |
| 380 | CGG | TGGCTGGCCTGCTTTCCTCT | 19531 | SpyCas9 | 31 | 0 |
| 381 | CGG | TGGCTGGCCTGCTTTCCTCT | 19532 | SpyCas9-HF1 | 31 | 0 |
| 382 | CGG | TGGCTGGCCTGCTTTCCTCT | 19533 | SpyCas9-SpG | 31 | 0 |
| 383 | CGG | TGGCTGGCCTGCTTTCCTCT | 19534 | SpyCas9-SpRY | 31 | 0 |
| 384 | CG | TGGCTGGCCTGCTTTCCTCT | 19535 | SpyCas9-NG | 31 | 0 |
| 385 | CG | TGGCTGGCCTGCTTTCCTCT | 19536 | SpyCas9-xCas | 31 | 0 |
| 386 | CG | TGGCTGGCCTGCTTTCCTCT | 19537 | SpyCas9-xCas-NG | 31 | 0 |
| 387 | TCT | TACATGGGCTTGGATCCATG | 19538 | SpyCas9-SpRY | 31 | 0 |
| 388 | TCGGG | ccTGTGGCTGGCCTGCTTTCCTC | 19539 | SauCas9 | 32 | 0 |
| 389 | TCGGG | TGTGGCTGGCCTGCTTTCCTC | 19540 | SauCas9KKH | 32 | 0 |
| 390 | TCGG | TGTGGCTGGCCTGCTTTCCTC | 19541 | SauriCas9 | 32 | 0 |
| 391 | TCGG | TGTGGCTGGCCTGCTTTCCTC | 19542 | SauriCas9-KKH | 32 | 0 |
| 392 | TCG | GTGGCTGGCCTGCTTTCCTC | 19543 | ScaCas9 | 32 | 0 |
| 393 | TCG | GTGGCTGGCCTGCTTTCCTC | 19544 | ScaCas9-HiFi-Sc++ | 32 | 0 |
| 394 | TCG | GTGGCTGGCCTGCTTTCCTC | 19545 | ScaCas9-Sc++ | 32 | 0 |
| 395 | TCG | GTGGCTGGCCTGCTTTCCTC | 19546 | SpyCas9-SpRY | 32 | 0 |
| 396 | GTC | ATACATGGGCTTGGATCCAT | 19547 | SpyCas9-SpRY | 32 | 0 |
| 397 | TCGGGA | TGTGGCTGGCCTGCTTTCCTC | 19548 | cCas9-v17 | 32 | 0 |
| 398 | TCGGGA | TGTGGCTGGCCTGCTTTCCTC | 19549 | cCas9-v42 | 32 | 0 |
| 399 | TCGGGATT | acctGTGGCTGGCCTGCTTTCCTC | 19550 | NmeCas9 | 32 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 400 | CTCGG | CTGTGGCTGGCCTGCTTTCCT | 19551 | SauCas9KKH | 33 | 0 |
| 401 | TG | TATACATGGGCTTGGATCCA | 19552 | Spy Cas9-NG | 33 | 0 |
| 402 | TG | TATACATGGGCTTGGATCCA | 19553 | SpyCas9-xCas | 33 | 0 |
| 403 | TG | TATACATGGGCTTGGATCCA | 19554 | SpyCas9-xCas-NG | 33 | 0 |
| 404 | TGT | TATACATGGGCTTGGATCCA | 19555 | SpyCas9-SpG | 33 | 0 |
| 405 | TGT | TATACATGGGCTTGGATCCA | 19556 | SpyCas9-SpRY | 33 | 0 |
| 406 | CTC | TGTGGCTGGCCTGCTTTCCT | 19557 | SpyCas9-SpRY | 33 | 0 |
| 407 | CTCGGG | CTGTGGCTGGCCTGCTTTCCT | 19558 | cCas9-v17 | 33 | 0 |
| 408 | CTCGGG | CTGTGGCTGGCCTGCTTTCCT | 19559 | cCas9-v42 | 33 | 0 |
| 409 | TGTC | TATACATGGGCTTGGATCCA | 19560 | SpyCas9-3var-NRTH | 33 | 0 |
| 410 | ATG | GTATACATGGGCTTGGATCC | 19561 | ScaCas9 | 34 | 0 |
| 411 | ATG | GTATACATGGGCTTGGATCC | 19562 | ScaCas9-HiFi-Sc++ | 34 | 0 |
| 412 | ATG | GTATACATGGGCTTGGATCC | 19563 | ScaCas9-Sc++ | 34 | 0 |
| 413 | ATG | GTATACATGGGCTTGGATCC | 19564 | SpyCas9-SpRY | 34 | 0 |
| 414 | TCT | CTGTGGCTGGCCTGCTTTCC | 19565 | SpyCas9-SpRY | 34 | 0 |
| 415 | ATGTCTGA | ggggTATACATGGGCTTGGATCC | 19566 | BlatCas9 | 34 | 0 |
| 416 | ATGTC | ggggTATACATGGGCTTGGATCC | 19567 | BlatCas9 | 34 | 0 |
| 417 | CAT | GGTATACATGGGCTTGGATC | 19568 | SpyCas9-SpRY | 35 | 0 |
| 418 | CTC | CCTGTGGCTGGCCTGCTTTC | 19569 | SpyCas9-SpRY | 35 | 0 |
| 419 | CTCTCGGG | cgacCTGTGGCTGGCCTGCTTTC | 19570 | BlatCas9 | 35 | 0 |
| 420 | CTCTC | cgacCTGTGGCTGGCCTGCTTTC | 19571 | BlatCas9 | 35 | 0 |
| 421 | CCA | GGGTATACATGGGCTTGGAT | 19572 | SpyCas9-SpRY | 36 | 0) |
| 422 | CCT | ACCTGTGGCTGGCCTGCTTT | 19573 | SpyCas9-SpRY | 36 | 0 |
| 423 | CCATGTCT | tcggGGGTATACATGGGCTTGGAT | 19574 | NmeCas9 | 36 | 0 |
| 424 | TCC | GGGGTATACATGGGCTTGGA | 19575 | SpyCas9-SpRY | 37 | 0 |
| 425 | TCC | GACCTGTGGCTGGCCTGCTT | 19576 | SpyCas9-SpRY | 37 | 0 |
| 426 | TCCTC | tccgACCTGTGGCTGGCCTGCTT | 19577 | BlatCas9 | 37 | 0 |
| 427 | ATC | GGGGGTATACATGGGCTTGG | 19578 | SpyCas9-SpRY | 38 | 0 |
| 428 | TTC | CGACCTGTGGCTGGCCTGCT | 19579 | SpyCas9-SpRY | 38 | 0 |
| 429 | GAT | CGGGGGTATACATGGGCTTG | 19580 | SpyCas9-SpRY | 39 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 430 | GAT | CGGGGGTATACATGGGCTTG | 19581 | SpyCas9-xCas | 39 | 0 |
| 431 | TTT | CCGACCTGTGGCTGGCCTGC | 19582 | Spy Cas9-SpRY | 39 | 0 |
| 432 | GATCCATG | gttcGGGGGTATACATGGGCTTG | 19583 | BlatCas9 | 39 | 0 |
| 433 | GATCC | gttcGGGGGTATACATGGGCTTG | 19584 | BlatCas9 | 39 | 0 |
| 434 | TTTCC | cctcCGACCTGTGGCTGGCCTGC | 19585 | BlatCas9 | 39 | 0 |
| 435 | GATC | CGGGGGTATACATGGGCTTG | 19586 | SpyCas9-3var-NRTH | 39 | 0 |
| 436 | GGATCC | cgGTTCGGGGGTATACATGGGCTT | 19587 | Nme2Cas9 | 40 | 0 |
| 437 | CTTTCC | cgCCTCCGACCTGTGGCTGGCCTG | 19588 | Nme2Cas9 | 40 | 0 |
| 438 | GG | TCGGGGGTATACATGGGCTT | 19589 | SpyCas9-NG | 40 | 0 |
| 439 | GG | TCGGGGGTATACATGGGCTT | 19590 | SpyCas9-xCas | 40 | 0 |
| 440 | GG | TCGGGGGTATACATGGGCTT | 19591 | SpyCas9-xCas-NG | 40 | 0 |
| 441 | GGA | TCGGGGGTATACATGGGCTT | 19592 | SpyCas9-SpG | 40 | 0 |
| 442 | GGA | TCGGGGGTATACATGGGCTT | 19593 | SpyCas9-SpRY | 40 | 0 |
| 443 | CTT | TCCGACCTGTGGCTGGCCTG | 19594 | SpyCas9-SpRY | 40 | 0 |
| 444 | GGATCCAT | ggttCGGGGGTATACATGGGCTT | 19595 | BlatCas9 | 40 | 0 |
| 445 | GGATC | ggttCGGGGGTATACATGGGCTT | 19596 | BlatCas9 | 40 | 0 |
| 446 | CTTTC | gcctCCGACCTGTGGCTGGCCTG | 19597 | BlatCas9 | 40 | 0 |
| 447 | GGAT | TCGGGGGTATACATGGGCTT | 19598 | SpyCas9-3var-NRRH | 40 | 0 |
| 448 | GGAT | TCGGGGGTATACATGGGCTT | 19599 | SpyCas9-VQR | 40 | 0 |
| 449 | TGG | TTCGGGGGTATACATGGGCT | 19600 | ScaCas9 | 41 | 0 |
| 450 | TGG | TTCGGGGGTATACATGGGCT | 19601 | ScaCas9-HiFi-Sc++ | 41 | 0 |
| 451 | TGG | TTCGGGGGTATACATGGGCT | 19602 | ScaCas9-Sc++ | 41 | 0 |
| 452 | TGG | TTCGGGGGTATACATGGGCT | 19603 | SpyCas9 | 41 | 0 |
| 453 | TGG | TTCGGGGGTATACATGGGCT | 19604 | SpyCas9-HF1 | 41 | 0 |
| 454 | TGG | TTCGGGGGTATACATGGGCT | 19605 | SpyCas9-SpG | 41 | 0 |
| 455 | TGG | TTCGGGGGTATACATGGGCT | 19606 | SpyCas9-SpRY | 41 | 0 |
| 456 | TG | TTCGGGGGTATACATGGGCT | 19607 | SpyCas9-NG | 41 | 0 |
| 457 | TG | TTCGGGGGTATACATGGGCT | 19608 | SpyCas9-xCas | 41 | 0 |
| 458 | TG | TTCGGGGGTATACATGGGCT | 19609 | SpyCas9-xCas-NG | 41 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 459 | GCT | CTCCGACCTGTGGCTGGCCT | 19610 | SpyCas9-SpRY | 41 | 0 |
| 460 | TGGATCC | GGTTCGGGGGTATACATGGGCT | 19611 | CdiCas9 | 41 | 0 |
| 461 | TGGA | TTCGGGGGTATACATGGGCT | 19612 | SpyCas9-3var-NRRH | 41 | 0 |
| 462 | TTGGA | acGGTTCGGGGGTATACATGGGC | 19613 | SauCas9 | 42 | 0 |
| 463 | TTGGA | GGTTCGGGGGTATACATGGGC | 19614 | SauCas9KKH | 42 | 0 |
| 464 | TTGGAT | acGGTTCGGGGGTATACATGGGC | 19615 | SauCas9 | 42 | 0 |
| 465 | TTGGAT | GGTTCGGGGGTATACATGGGC | 19616 | SauCas9KKH | 42 | 0 |
| 466 | TTGGAT | GGTTCGGGGGTATACATGGGC | 19617 | cCas9-v17 | 42 | 0 |
| 467 | TTGGAT | GGTTCGGGGGTATACATGGGC | 19618 | cCas9-v42 | 42 | 0 |
| 468 | TTGG | GGTTCGGGGGTATACATGGGC | 19619 | SauriCas9 | 42 | 0 |
| 469 | TTGG | GGTTCGGGGGTATACATGGGC | 19620 | SauriCas9-KKH | 42 | 0 |
| 470 | TTG | GTTCGGGGGTATACATGGGC | 19621 | ScaCas9 | 42 | 0 |
| 471 | TTG | GTTCGGGGGTATACATGGGC | 19622 | ScaCas9-HiFi-Sc++ | 42 | 0 |
| 472 | TTG | GTTCGGGGGTATACATGGGC | 19623 | ScaCas9-Sc++ | 42 | 0 |
| 473 | TTG | GTTCGGGGGTATACATGGGC | 19624 | SpyCas9-SpRY | 42 | 0 |
| 474 | TG | CCTCCGACCTGTGGCTGGCC | 19625 | SpyCas9-NG | 42 | 0 |
| 475 | TG | CCTCCGACCTGTGGCTGGCC | 19626 | SpyCas9-xCas | 42 | 0 |
| 476 | TG | CCTCCGACCTGTGGCTGGCC | 19627 | SpyCas9-xCas-NG | 42 | 0 |
| 477 | TGC | CCTCCGACCTGTGGCTGGCC | 19628 | SpyCas9-SpG | 42 | 0 |
| 478 | TGC | CCTCCGACCTGTGGCTGGCC | 19629 | SpyCas9-SpRY | 42 | 0 |
| 479 | TGCT | CCTCCGACCTGTGGCTGGCC | 19630 | SpyCas9-3var-NRCH | 42 | 0 |
| 480 | CTTGG | CGGTTCGGGGGTATACATGGG | 19631 | SauCas9KKH | 43 | 0 |
| 481 | CTG | GCCTCCGACCTGTGGCTGGC | 19632 | ScaCas9 | 43 | 0 |
| 482 | CTG | GCCTCCGACCTGTGGCTGGC | 19633 | ScaCas9-HiFi-Sc++ | 43 | 0 |
| 483 | CTG | GCCTCCGACCTGTGGCTGGC | 19634 | ScaCas9-Sc++ | 43 | 0 |
| 484 | CTG | GCCTCCGACCTGTGGCTGGC | 19635 | SpyCas9-SpRY | 43 | 0 |
| 485 | CTT | GGTTCGGGGGTATACATGGG | 19636 | SpyCas9-SpRY | 43 | 0 |
| 486 | CTGCTTT | CCGCCTCCGACCTGTGGCTGGC | 19637 | CdiCas9 | 43 | 0 |
| 487 | GCT | CGGTTCGGGGGTATACATGG | 19638 | SpyCas9-SpRY | 44 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 488 | CCT | CGCCTCCGACCTGTGGCTGG | 19639 | SpyCas9-SpRY | 44 | 0 |
| 489 | CCTGCTTT | ttccGCCTCCGACCTGTGGCTGG | 19640 | BlatCas9 | 44 | 0 |
| 490 | CCTGC | ttccGCCTCCGACCTGTGGCTGG | 19641 | BlatCas9 | 44 | 0 |
| 491 | GG | ACGGTTCGGGGGTATACATG | 19642 | SpyCas9-NG | 45 | 0 |
| 492 | GG | ACGGTTCGGGGGTATACATG | 19643 | SpyCas9-xCas | 45 | 0 |
| 493 | GG | ACGGTTCGGGGGTATACATG | 19644 | SpyCas9-xCas-NG | 45 | 0 |
| 494 | GGC | ACGGTTCGGGGGTATACATG | 19645 | SpyCas9-SpG | 45 | 0 |
| 495 | GGC | ACGGTTCGGGGGTATACATG | 19646 | SpyCas9-SpRY | 45 | 0 |
| 496 | GCC | CCGCCTCCGACCTGTGGCTG | 19647 | SpyCas9-SpRY | 45 | 0 |
| 497 | GCCTGCTT | gtttCCGCCTCCGACCTGTGGCTG | 19648 | NmeCas9 | 45 | 0 |
| 498 | GGCT | ACGGTTCGGGGGTATACATG | 19649 | SpyCas9-3var-NRCH | 45 | 0 |
| 499 | GGG | CACGGTTCGGGGGTATACAT | 19650 | ScaCas9 | 46 | 0 |
| 500 | GGG | CACGGTTCGGGGGTATACAT | 19651 | ScaCas9-HiFi-Sc++ | 46 | 0 |
| 501 | GGG | CACGGTTCGGGGGTATACAT | 19652 | ScaCas9-Sc++ | 46 | 0 |
| 502 | GGG | CACGGTTCGGGGGTATACAT | 19653 | SpyCas9 | 46 | 0 |
| 503 | GGG | CACGGTTCGGGGGTATACAT | 19654 | SpyCas9-HF1 | 46 | 0 |
| 504 | GGG | CACGGTTCGGGGGTATACAT | 19655 | SpyCas9-SpG | 46 | 0 |
| 505 | GGG | CACGGTTCGGGGGTATACAT | 19656 | SpyCas9-SpRY | 46 | 0 |
| 506 | GG | CACGGTTCGGGGGTATACAT | 19657 | SpyCas9-NG | 46 | 0 |
| 507 | GG | CACGGTTCGGGGGTATACAT | 19658 | SpyCas9-xCas | 46 | 0 |
| 508 | GG | CACGGTTCGGGGGTATACAT | 19659 | SpyCas9-xCas-NG | 46 | 0 |
| 509 | GG | TCCGCCTCCGACCTGTGGCT | 19660 | SpyCas9-NG | 46 | 0 |
| 510 | GG | TCCGCCTCCGACCTGTGGCT | 19661 | SpyCas9-xCas | 46 | 0 |
| 511 | GG | TCCGCCTCCGACCTGTGGCT | 19662 | SpyCas9-xCas-NG | 46 | 0 |
| 512 | GGC | TCCGCCTCCGACCTGTGGCT | 19663 | SpyCas9-SpG | 46 | 0 |
| 513 | GGC | TCCGCCTCCGACCTGTGGCT | 19664 | SpyCas9-SpRY | 46 | 0 |
| 514 | GGGC | CACGGTTCGGGGGTATACAT | 19665 | SpyCas9-3var-NRRH | 46 | 0 |
| 515 | GGCC | TCCGCCTCCGACCTGTGGCT | 19666 | SpyCas9-3var-NRCH | 46 | 0 |
| 516 | TGGG | CTCACGGTTCGGGGGTATACA | 19667 | SauriCas9 | 47 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 517 | TGGG | CTCACGGTTCGGGGGTATACA | 19668 | SauriCas9-KKH | 47 | 0 |
| 518 | TGG | TCACGGTTCGGGGGTATACA | 19669 | ScaCas9 | 47 | 0 |
| 519 | TGG | TCACGGTTCGGGGGTATACA | 19670 | ScaCas9-HiFi-Sc++ | 47 | 0 |
| 520 | TGG | TCACGGTTCGGGGGTATACA | 19671 | ScaCas9-Sc++ | 47 | 0 |
| 521 | TGG | TCACGGTTCGGGGGTATACA | 19672 | SpyCas9 | 47 | 0 |
| 522 | TGG | TCACGGTTCGGGGGTATACA | 19673 | SpyCas9-HF1 | 47 | 0 |
| 523 | TGG | TCACGGTTCGGGGGTATACA | 19674 | SpyCas9-SpG | 47 | 0 |
| 524 | TGG | TCACGGTTCGGGGGTATACA | 19675 | SpyCas9-SpRY | 47 | 0 |
| 525 | TGG | TTCCGCCTCCGACCTGTGGC | 19676 | ScaCas9 | 47 | 0 |
| 526 | TGG | TTCCGCCTCCGACCTGTGGC | 19677 | ScaCas9-HiFi-Sc++ | 47 | 0 |
| 527 | TGG | TTCCGCCTCCGACCTGTGGC | 19678 | ScaCas9-Sc++ | 47 | 0 |
| 528 | TGG | TTCCGCCTCCGACCTGTGGC | 19679 | SpyCas9 | 47 | 0 |
| 529 | TGG | TTCCGCCTCCGACCTGTGGC | 19680 | SpyCas9-HF1 | 47 | 0 |
| 530 | TGG | TTCCGCCTCCGACCTGTGGC | 19681 | SpyCas9-SpG | 47 | 0 |
| 531 | TGG | TTCCGCCTCCGACCTGTGGC | 19682 | SpyCas9-SpRY | 47 | 0 |
| 532 | TG | TCACGGTTCGGGGGTATACA | 19683 | SpyCas9-NG | 47 | 0 |
| 533 | TG | TCACGGTTCGGGGGTATACA | 19684 | SpyCas9-xCas | 47 | 0 |
| 534 | TG | TCACGGTTCGGGGGTATACA | 19685 | SpyCas9-xCas-NG | 47 | 0 |
| 535 | TG | TTCCGCCTCCGACCTGTGGC | 19686 | SpyCas9-NG | 47 | 0 |
| 536 | TG | TTCCGCCTCCGACCTGTGGC | 19687 | SpyCas9-xCas | 47 | 0 |
| 537 | TG | TTCCGCCTCCGACCTGTGGC | 19688 | SpyCas9-xCas-NG | 47 | 0 |
| 538 | TGGGCTTG | tactCACGGTTCGGGGGTATACA | 19689 | BlatCas9 | 47 | 0 |
| 539 | TGGGC | tactCACGGTTCGGGGGTATACA | 19690 | BlatCas9 | 47 | 0 |
| 540 | TGGCC | ggttTCCGCCTCCGACCTGTGGC | 19691 | BlatCas9 | 47 | 0 |
| 541 | TGGGCT | CTCACGGTTCGGGGGTATACA | 19692 | cCas9-v16 | 47 | 0 |
| 542 | TGGGCT | CTCACGGTTCGGGGGTATACA | 19693 | cCas9-v21 | 47 | 0 |
| 543 | TGGC | TTCCGCCTCCGACCTGTGGC | 19694 | SpyCas9-3var-NRRH | 47 | 0 |
| 544 | CTGGCC | ctGGTTTCCGCCTCCGACCTGTGG | 19695 | Nme2Cas9 | 48 | 0 |
| 545 | ATGGG | gtACTCACGGTTCGGGGGTATAC | 19696 | SauCas9 | 48 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 546 | ATGGG | ACTCACGGTTCGGGGGTATAC | 19697 | SauCas9KKH | 48 | 0 |
| 547 | ATGG | ACTCACGGTTCGGGGGTATAC | 19698 | SauriCas9 | 48 | 0 |
| 548 | ATGG | ACTCACGGTTCGGGGGTATAC | 19699 | SauriCas9-KKH | 48 | 0 |
| 549 | CTGG | GTTTCCGCCTCCGACCTGTGG | 19700 | SauriCas9 | 48 | 0 |
| 550 | CTGG | GTTTCCGCCTCCGACCTGTGG | 19701 | SauriCas9-KKH | 48 | 0 |
| 551 | ATG | CTCACGGTTCGGGGGTATAC | 19702 | ScaCas9 | 48 | 0 |
| 552 | ATG | CTCACGGTTCGGGGGTATAC | 19703 | ScaCas9-HiFi-Sc++ | 48 | 0 |
| 553 | ATG | CTCACGGTTCGGGGGTATAC | 19704 | ScaCas9-Sc++ | 48 | 0 |
| 554 | ATG | CTCACGGTTCGGGGGTATAC | 19705 | SpyCas9-SpRY | 48 | 0 |
| 555 | CTG | TTTCCGCCTCCGACCTGTGG | 19706 | ScaCas9 | 48 | 0 |
| 556 | CTG | TTTCCGCCTCCGACCTGTGG | 19707 | ScaCas9-HiFi-Sc++ | 48 | 0 |
| 557 | CTG | TTTCCGCCTCCGACCTGTGG | 19708 | ScaCas9-Sc++ | 48 | 0 |
| 558 | CTG | TTTCCGCCTCCGACCTGTGG | 19709 | SpyCas9-SpRY | 48 | 0 |
| 559 | CTGGCCTG | tggtTTCCGCCTCCGACCTGTGG | 19710 | BlatCas9 | 48 | 0 |
| 560 | CTGGC | tggtTTCCGCCTCCGACCTGTGG | 19711 | BlatCas9 | 48 | 0 |
| 561 | ATGGGC | ACTCACGGTTCGGGGGTATAC | 19712 | cCas9-v17 | 48 | 0 |
| 562 | ATGGGC | ACTCACGGTTCGGGGGTATAC | 19713 | cCas9-v42 | 48 | 0 |
| 563 | ATGGGCTT | agtaCTCACGGTTCGGGGGTATAC | 19714 | NmeCas9 | 48 | 0 |
| 564 | CATGG | TACTCACGGTTCGGGGGTATA | 19715 | SauCas9KKH | 49 | 0 |
| 565 | GCTGG | GGTTTCCGCCTCCGACCTGTG | 19716 | SauCas9KKH | 49 | 0 |
| 566 | CAT | ACTCACGGTTCGGGGGTATA | 19717 | SpyCas9-SpRY | 49 | 0 |
| 567 | GCT | GTTTCCGCCTCCGACCTGTG | 19718 | SpyCas9-SpRY | 49 | 0 |
| 568 | GG | GGTTTCCGCCTCCGACCTGT | 19719 | SpyCas9-NG | 50 | 0 |
| 569 | GG | GGTTTCCGCCTCCGACCTGT | 19720 | SpyCas9-xCas | 50 | 0 |
| 570 | GG | GGTTTCCGCCTCCGACCTGT | 19721 | SpyCas9-xCas-NG | 50 | 0 |
| 571 | GGC | GGTTTCCGCCTCCGACCTGT | 19722 | SpyCas9-SpG | 50 | 0 |
| 572 | GGC | GGTTTCCGCCTCCGACCTGT | 19723 | SpyCas9-SpRY | 50 | 0 |
| 573 | ACA | TACTCACGGTTCGGGGGTAT | 19724 | Spy Cas9-SpRY | 50 | 0 |
| 574 | GGCT | GGTTTCCGCCTCCGACCTGT | 19725 | SpyCas9-3var-NRCH | 50 | 0 |
| 575 | TGG | TGGTTTCCGCCTCCGACCTG | 19726 | ScaCas9 | 51 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 576 | TGG | TGGTTTCCGCCTCCGACCTG | 19727 | ScaCas9-HiFi-Sc++ | 51 | 0 |
| 577 | TGG | TGGTTTCCGCCTCCGACCTG | 19728 | ScaCas9-Sc++ | 51 | 0 |
| 578 | TGG | TGGTTTCCGCCTCCGACCTG | 19729 | SpyCas9 | 51 | 0 |
| 579 | TGG | TGGTTTCCGCCTCCGACCTG | 19730 | SpyCas9-HF1 | 51 | 0 |
| 580 | TGG | TGGTTTCCGCCTCCGACCTG | 19731 | SpyCas9-SpG | 51 | 0 |
| 581 | TGG | TGGTTTCCGCCTCCGACCTG | 19732 | SpyCas9-SpRY | 51 | 0 |
| 582 | TG | TGGTTTCCGCCTCCGACCTG | 19733 | SpyCas9-NG | 51 | 0 |
| 583 | TG | TGGTTTCCGCCTCCGACCTG | 19734 | SpyCas9-xCas | 51 | 0 |
| 584 | TG | TGGTTTCCGCCTCCGACCTG | 19735 | SpyCas9-xCas-NG | 51 | 0 |
| 585 | TAC | GTACTCACGGTTCGGGGGTA | 19736 | SpyCas9-SpRY | 51 | 0 |
| 586 | TGGC | TGGTTTCCGCCTCCGACCTG | 19737 | SpyCas9-3var-NRRH | 51 | 0 |
| 587 | TACA | GTACTCACGGTTCGGGGGTA | 19738 | SpyCas9-3var-NRCH | 51 | 0 |
| 588 | GTGG | ACTGGTTTCCGCCTCCGACCT | 19739 | SauriCas9 | 52 | 0 |
| 589 | GTGG | ACTGGTTTCCGCCTCCGACCT | 19740 | SauriCas9-KKH | 52 | 0 |
| 590 | GTG | CTGGTTTCCGCCTCCGACCT | 19741 | ScaCas9 | 52 | 0 |
| 591 | GTG | CTGGTTTCCGCCTCCGACCT | 19742 | ScaCas9-HiFi-Sc++ | 52 | 0 |
| 592 | GTG | CTGGTTTCCGCCTCCGACCT | 19743 | ScaCas9-Sc++ | 52 | 0 |
| 593 | GTG | CTGGTTTCCGCCTCCGACCT | 19744 | SpyCas9-SpRY | 52 | 0 |
| 594 | ATA | AGTACTCACGGTTCGGGGGT | 19745 | SpyCas9-SpRY | 52 | 0 |
| 595 | GTGGCTGG | gcacTGGTTTCCGCCTCCGACCT | 19746 | BlatCas9 | 52 | 0 |
| 596 | GTGGC | gcacTGGTTTCCGCCTCCGACCT | 19747 | BlatCas9 | 52 | 0 |
| 597 | GTGGCT | ACTGGTTTCCGCCTCCGACCT | 19748 | cCas9-v16 | 52 | 0 |
| 598 | GTGGCT | ACTGGTTTCCGCCTCCGACCT | 19749 | cCas9-v21 | 52 | 0 |
| 599 | TGTGG | CACTGGTTTCCGCCTCCGACC | 19750 | SauCas9KKH | 53 | 0 |
| 600 | TG | ACTGGTTTCCGCCTCCGACC | 19751 | SpyCas9-NG | 53 | 0 |
| 601 | TG | ACTGGTTTCCGCCTCCGACC | 19752 | SpyCas9-xCas | 53 | 0 |
| 602 | TG | ACTGGTTTCCGCCTCCGACC | 19753 | SpyCas9-xCas-NG | 53 | 0 |
| 603 | TAT | CAGTACTCACGGTTCGGGGG | 19754 | SpyCas9-SpRY | 53 | 0 |
| 604 | TGT | ACTGGTTTCCGCCTCCGACC | 19755 | SpyCas9-SpG | 53 | 0 |
| 605 | TGT | ACTGGTTTCCGCCTCCGACC | 19756 | SpyCas9-SpRY | 53 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 606 | TATACATG | ggacAGTACTCACGGTTCGGGGG | 19757 | BlatCas9 | 53 | 0 |
| 607 | TATAC | ggacAGTACTCACGGTTCGGGGG | 19758 | BlatCas9 | 53 | 0 |
| 608 | TATA | CAGTACTCACGGTTCGGGGG | 19759 | SpyCas9-3var-NRTH | 53 | 0 |
| 609 | CTG | CACTGGTTTCCGCCTCCGAC | 19760 | ScaCas9 | 54 | 0 |
| 610 | CTG | CACTGGTTTCCGCCTCCGAC | 19761 | ScaCas9-HiFi-Sc++ | 54 | 0 |
| 611 | CTG | CACTGGTTTCCGCCTCCGAC | 19762 | ScaCas9-Sc++ | 54 | 0 |
| 612 | CTG | CACTGGTTTCCGCCTCCGAC | 19763 | SpyCas9-SpRY | 54 | 0 |
| 613 | GTA | ACAGTACTCACGGTTCGGGG | 19764 | SpyCas9-SpRY | 54 | 0 |
| 614 | GG | GACAGTACTCACGGTTCGGG | 19765 | SpyCas9-NG | 55 | 0 |
| 615 | GG | GACAGTACTCACGGTTCGGG | 19766 | SpyCas9-xCas | 55 | 0 |
| 616 | GG | GACAGTACTCACGGTTCGGG | 19767 | SpyCas9-xCas-NG | 55 | 0 |
| 617 | GGT | GACAGTACTCACGGTTCGGG | 19768 | SpyCas9-SpG | 55 | 0 |
| 618 | GGT | GACAGTACTCACGGTTCGGG | 19769 | SpyCas9-SpRY | 55 | 0 |
| 619 | CCT | GCACTGGTTTCCGCCTCCGA | 19770 | SpyCas9-SpRY | 55 | 0 |
| 620 | GGTA | GACAGTACTCACGGTTCGGG | 19771 | SpyCas9-3var-NRTH | 55 | 0 |
| 621 | GGG | GGACAGTACTCACGGTTCGG | 19772 | ScaCas9 | 56 | 0 |
| 622 | GGG | GGACAGTACTCACGGTTCGG | 19773 | ScaCas9-HiFi-Sc++ | 56 | 0 |
| 623 | GGG | GGACAGTACTCACGGTTCGG | 19774 | ScaCas9-Sc++ | 56 | 0 |
| 624 | GGG | GGACAGTACTCACGGTTCGG | 19775 | SpyCas9 | 56 | 0 |
| 625 | GGG | GGACAGTACTCACGGTTCGG | 19776 | SpyCas9-HF1 | 56 | 0 |
| 626 | GGG | GGACAGTACTCACGGTTCGG | 19777 | SpyCas9-SpG | 56 | 0 |
| 627 | GGG | GGACAGTACTCACGGTTCGG | 19778 | SpyCas9-SpRY | 56 | 0 |
| 628 | GG | GGACAGTACTCACGGTTCGG | 19779 | SpyCas9-NG | 56 | 0 |
| 629 | GG | GGACAGTACTCACGGTTCGG | 19780 | SpyCas9-xCas | 56 | 0 |
| 630 | GG | GGACAGTACTCACGGTTCGG | 19781 | SpyCas9-xCas-NG | 56 | 0 |
| 631 | ACC | TGCACTGGTTTCCGCCTCCG | 19782 | SpyCas9-SpRY | 56 | 0 |
| 632 | GGGTATAC | ggAGGACAGTACTCACGGTTCGG | 19783 | CjeCas9 | 56 | 0 |
| 633 | GGGT | GGACAGTACTCACGGTTCGG | 19784 | SpyCas9-3var-NRRH | 56 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 634 | GGGG | GAGGACAGTACTCACGGTTCG | 19785 | SauriCas9 | 57 | 0 |
| 635 | GGGG | GAGGACAGTACTCACGGTTCG | 19786 | SauriCas9-KKH | 57 | 0 |
| 636 | GGG | AGGACAGTACTCACGGTTCG | 19787 | ScaCas9 | 57 | 0 |
| 637 | GGG | AGGACAGTACTCACGGTTCG | 19788 | ScaCas9-HiFi-Sc++ | 57 | 0 |
| 638 | GGG | AGGACAGTACTCACGGTTCG | 19789 | ScaCas9-Sc++ | 57 | 0 |
| 639 | GGG | AGGACAGTACTCACGGTTCG | 19790 | SpyCas9 | 57 | 0 |
| 640 | GGG | AGGACAGTACTCACGGTTCG | 19791 | SpyCas9-HF1 | 57 | 0 |
| 641 | GGG | AGGACAGTACTCACGGTTCG | 19792 | SpyCas9-SpG | 57 | 0 |
| 642 | GGG | AGGACAGTACTCACGGTTCG | 19793 | SpyCas9-SpRY | 57 | 0 |
| 643 | GG | AGGACAGTACTCACGGTTCG | 19794 | SpyCas9-NG | 57 | 0 |
| 644 | GG | AGGACAGTACTCACGGTTCG | 19795 | SpyCas9-xCas | 57 | 0 |
| 645 | GG | AGGACAGTACTCACGGTTCG | 19796 | SpyCas9-xCas-NG | 57 | 0 |
| 646 | GAC | TTGCACTGGTTTCCGCCTCC | 19797 | SpyCas9-SpRY | 57 | 0 |
| 647 | GACC | TTGCACTGGTTTCCGCCTCC | 19798 | SpyCas9-3var-NRCH | 57 | 0 |
| 648 | GGGGG | ctGGAGGACAGTACTCACGGTTC | 19799 | SauCas9 | 58 | 0 |
| 649 | GGGGG | GGAGGACAGTACTCACGGTTC | 19800 | SauCas9KKH | 58 | 0 |
| 650 | GGGGGT | ctGGAGGACAGTACTCACGGTTC | 19801 | SauCas9 | 58 | 0 |
| 651 | GGGGGT | GGAGGACAGTACTCACGGTTC | 19802 | SauCas9KKH | 58 | 0 |
| 652 | GGGGGT | GGAGGACAGTACTCACGGTTC | 19803 | cCas9-v17 | 58 | 0 |
| 653 | GGGGGT | GGAGGACAGTACTCACGGTTC | 19804 | cCas9-v42 | 58 | 0 |
| 654 | GGGG | GGAGGACAGTACTCACGGTTC | 19805 | SauriCas9 | 58 | 0 |
| 655 | GGGG | GGAGGACAGTACTCACGGTTC | 19806 | SauriCas9-KKH | 58 | 0 |
| 656 | GGG | GAGGACAGTACTCACGGTTC | 19807 | ScaCas9 | 58 | 0 |
| 657 | GGG | GAGGACAGTACTCACGGTTC | 19808 | ScaCas9-HiFi-Sc++ | 58 | 0 |
| 658 | GGG | GAGGACAGTACTCACGGTTC | 19809 | ScaCas9-Sc++ | 58 | 0 |
| 659 | GGG | GAGGACAGTACTCACGGTTC | 19810 | SpyCas9 | 58 | 0 |
| 660 | GGG | GAGGACAGTACTCACGGTTC | 19811 | SpyCas9-HF1 | 58 | 0 |
| 661 | GGG | GAGGACAGTACTCACGGTTC | 19812 | SpyCas9-SpG | 58 | 0 |
| 662 | GGG | GAGGACAGTACTCACGGTTC | 19813 | SpyCas9-SpRY | 58 | 0 |
| 663 | GG | GAGGACAGTACTCACGGTTC | 19814 | SpyCas9-NG | 58 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 664 | GG | GAGGACAGTACTCACGGTTC | 19815 | SpyCas9-xCas | 58 | 0 |
| 665 | GG | GAGGACAGTACTCACGGTTC | 19816 | SpyCas9-xCas-NG | 58 | 0 |
| 666 | CG | CTTGCACTGGTTTCCGCCTC | 19817 | SpyCas9-NG | 58 | 0 |
| 667 | CG | CTTGCACTGGTTTCCGCCTC | 19818 | SpyCas9-xCas | 58 | 0 |
| 668 | CG | CTTGCACTGGTTTCCGCCTC | 19819 | SpyCas9-xCas-NG | 58 | 0 |
| 669 | CGA | CTTGCACTGGTTTCCGCCTC | 19820 | SpyCas9-SpG | 58 | 0 |
| 670 | CGA | CTTGCACTGGTTTCCGCCTC | 19821 | SpyCas9-SpRY | 58 | 0 |
| 671 | CGACCTGT | cagcTTGCACTGGTTTCCGCCTC | 19822 | BlatCas9 | 58 | 0 |
| 672 | CGACC | cagcTTGCACTGGTTTCCGCCTC | 19823 | BlatCas9 | 58 | 0 |
| 673 | CGAC | CTTGCACTGGTTTCCGCCTC | 19824 | SpyCas9-3var-NRRH | 58 | 0 |
| 674 | CGAC | CTTGCACTGGTTTCCGCCTC | 19825 | SpyCas9-VQR | 58 | 0 |
| 675 | CCGACC | ccCAGCTTGCACTGGTTTCCGCCT | 19826 | Nme2Cas9 | 59 | 0 |
| 676 | CGGGG | gcTGGAGGACAGTACTCACGGTT | 19827 | SauCas9 | 59 | 0 |
| 677 | CGGGG | TGGAGGACAGTACTCACGGTT | 19828 | SauCas9KKH | 59 | 0 |
| 678 | CGGG | TGGAGGACAGTACTCACGGTT | 19829 | SauriCas9 | 59 | 0 |
| 679 | CGGG | TGGAGGACAGTACTCACGGTT | 19830 | SauriCas9-KKH | 59 | 0 |
| 680 | CGG | GGAGGACAGTACTCACGGTT | 19831 | ScaCas9 | 59 | 0 |
| 681 | CGG | GGAGGACAGTACTCACGGTT | 19832 | ScaCas9-HiFi-Sc++ | 59 | 0 |
| 682 | CGG | GGAGGACAGTACTCACGGTT | 19833 | ScaCas9-Sc++ | 59 | 0 |
| 683 | CGG | GGAGGACAGTACTCACGGTT | 19834 | SpyCas9 | 59 | 0 |
| 684 | CGG | GGAGGACAGTACTCACGGTT | 19835 | SpyCas9-HF1 | 59 | 0 |
| 685 | CGG | GGAGGACAGTACTCACGGTT | 19836 | SpyCas9-SpG | 59 | 0 |
| 686 | CGG | GGAGGACAGTACTCACGGTT | 19837 | SpyCas9-SpRY | 59 | 0 |
| 687 | CCG | GCTTGCACTGGTTTCCGCCT | 19838 | ScaCas9 | 59 | 0 |
| 688 | CCG | GCTTGCACTGGTTTCCGCCT | 19839 | ScaCas9-HiFi-Sc++ | 59 | 0 |
| 689 | CCG | GCTTGCACTGGTTTCCGCCT | 19840 | ScaCas9-Sc++ | 59 | 0 |
| 690 | CCG | GCTTGCACTGGTTTCCGCCT | 19841 | SpyCas9-SpRY | 59 | 0 |
| 691 | CG | GGAGGACAGTACTCACGGTT | 19842 | SpyCas9-NG | 59 | 0 |
| 692 | CG | GGAGGACAGTACTCACGGTT | 19843 | SpyCas9-xCas | 59 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 693 | CG | GGAGGACAGTACTCACGGTT | 19844 | SpyCas9-xCas-NG | 59 | 0 |
| 694 | CCGACCTG | ccagCTTGCACTGGTTTCCGCCT | 19845 | BlatCas9 | 59 | 0 |
| 695 | CCGAC | ccagCTTGCACTGGTTTCCGCCT | 19846 | BlatCas9 | 59 | 0 |
| 696 | CGGGGG | TGGAGGACAGTACTCACGGTT | 19847 | cCas9-v17 | 59 | 0 |
| 697 | CGGGGG | TGGAGGACAGTACTCACGGTT | 19848 | cCas9-v42 | 59 | 0 |
| 698 | CCGACCT | CAGCTTGCACTGGTTTCCGCCT | 19849 | CdiCas9 | 59 | 0 |
| 699 | TCGGG | agCTGGAGGACAGTACTCACGGT | 19850 | SauCas9 | 60 | 0 |
| 700 | TCGGG | CTGGAGGACAGTACTCACGGT | 19851 | SauCas9KKH | 60 | 0 |
| 701 | TCCGA | CAGCTTGCACTGGTTTCCGCC | 19852 | SauCas9KKH | 60 | 0 |
| 702 | TCGG | CTGGAGGACAGTACTCACGGT | 19853 | SauriCas9 | 60 | 0 |
| 703 | TCGG | CTGGAGGACAGTACTCACGGT | 19854 | SauriCas9-KKH | 60 | 0 |
| 704 | TCG | TGGAGGACAGTACTCACGGT | 19855 | ScaCas9 | 60 | 0 |
| 705 | TCG | TGGAGGACAGTACTCACGGT | 19856 | ScaCas9-HiFi-Sc++ | 60 | 0 |
| 706 | TCG | TGGAGGACAGTACTCACGGT | 19857 | ScaCas9-Sc++ | 60 | 0 |
| 707 | TCG | TGGAGGACAGTACTCACGGT | 19858 | SpyCas9-SpRY | 60 | 0 |
| 708 | TCC | AGCTTGCACTGGTTTCCGCC | 19859 | SpyCas9-SpRY | 60 | 0 |
| 709 | TCGGGG | CTGGAGGACAGTACTCACGGT | 19860 | cCas9-v17 | 60 | 0 |
| 710 | TCGGGG | CTGGAGGACAGTACTCACGGT | 19861 | cCas9-v42 | 60 | 0 |
| 711 | TCCGAC | CAGCTTGCACTGGTTTCCGCC | 19862 | cCas9-v17 | 60 | 0 |
| 712 | TCCGAC | CAGCTTGCACTGGTTTCCGCC | 19863 | cCas9-v42 | 60 | 0 |
| 713 | TTCGG | GCTGGAGGACAGTACTCACGG | 19864 | SauCas9KKH | 61 | 0 |
| 714 | TTC | CTGGAGGACAGTACTCACGG | 19865 | SpyCas9-SpRY | 61 | 0 |
| 715 | CTC | CAGCTTGCACTGGTTTCCGC | 19866 | SpyCas9-SpRY | 61 | 0 |
| 716 | TTCGGG | GCTGGAGGACAGTACTCACGG | 19867 | cCas9-v17 | 61 | 0 |
| 717 | TTCGGG | GCTGGAGGACAGTACTCACGG | 19868 | cCas9-v42 | 61 | 0 |
| 718 | GTT | GCTGGAGGACAGTACTCACG | 19869 | SpyCas9-SpRY | 62 | 0 |
| 719 | CCT | CCAGCTTGCACTGGTTTCCG | 19870 | SpyCas9-SpRY | 62 | 0 |
| 720 | CCTCC | atccCAGCTTGCACTGGTTTCCG | 19871 | BlatCas9 | 62 | 0 |
| 721 | GCCTCC | tcATCCCAGCTTGCACTGGTTTCC | 19872 | Nme2Cas9 | 63 | 0 |
| 722 | GG | AGCTGGAGGACAGTACTCAC | 19873 | SpyCas9-NG | 63 | 0 |
| 723 | GG | AGCTGGAGGACAGTACTCAC | 19874 | SpyCas9-xCas | 63 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 724 | GG | AGCTGGAGGACAGTACTCAC | 19875 | SpyCas9-xCas-NG | 63 | 0 |
| 725 | GGT | AGCTGGAGGACAGTACTCAC | 19876 | SpyCas9-SpG | 63 | 0 |
| 726 | GGT | AGCTGGAGGACAGTACTCAC | 19877 | SpyCas9-SpRY | 63 | 0 |
| 727 | GCC | CCCAGCTTGCACTGGTTTCC | 19878 | SpyCas9-SpRY | 63 | 0 |
| 728 | GGTTCGGG | ggtaGCTGGAGGACAGTACTCAC | 19879 | BlatCas9 | 63 | 0 |
| 729 | GCCTCCGA | catcCCAGCTTGCACTGGTTTCC | 19880 | BlatCas9 | 63 | 0 |
| 730 | GGTTC | ggtaGCTGGAGGACAGTACTCAC | 19881 | BlatCas9 | 63 | 0 |
| 731 | GCCTC | catcCCAGCTTGCACTGGTTTCC | 19882 | BlatCas9 | 63 | 0 |
| 732 | GGTT | AGCTGGAGGACAGTACTCAC | 19883 | SpyCas9-3var-NRTH | 63 | 0 |
| 733 | CGG | TAGCTGGAGGACAGTACTCA | 19884 | ScaCas9 | 64 | 0 |
| 734 | CGG | TAGCTGGAGGACAGTACTCA | 19885 | ScaCas9-HiFi-Sc++ | 64 | 0 |
| 735 | CGG | TAGCTGGAGGACAGTACTCA | 19886 | ScaCas9-Sc++ | 64 | 0 |
| 736 | CGG | TAGCTGGAGGACAGTACTCA | 19887 | Spy Cas9 | 64 | 0 |
| 737 | CGG | TAGCTGGAGGACAGTACTCA | 19888 | SpyCas9-HF1 | 64 | 0 |
| 738 | CGG | TAGCTGGAGGACAGTACTCA | 19889 | SpyCas9-SpG | 64 | 0 |
| 739 | CGG | TAGCTGGAGGACAGTACTCA | 19890 | SpyCas9-SpRY | 64 | 0 |
| 740 | CG | TAGCTGGAGGACAGTACTCA | 19891 | SpyCas9-NG | 64 | 0 |
| 741 | CG | TAGCTGGAGGACAGTACTCA | 19892 | SpyCas9-xCas | 64 | 0 |
| 742 | CG | TAGCTGGAGGACAGTACTCA | 19893 | SpyCas9-xCas-NG | 64 | 0 |
| 743 | CG | TCCCAGCTTGCACTGGTTTC | 19894 | SpyCas9-NG | 64 | 0 |
| 744 | CG | TCCCAGCTTGCACTGGTTTC | 19895 | SpyCas9-xCas | 64 | 0 |
| 745 | CG | TCCCAGCTTGCACTGGTTTC | 19896 | SpyCas9-xCas-NG | 64 | 0 |
| 746 | CGC | TCCCAGCTTGCACTGGTTTC | 19897 | SpyCas9-SpG | 64 | 0 |
| 747 | CGC | TCCCAGCTTGCACTGGTTTC | 19898 | SpyCas9-SpRY | 64 | 0 |
| 748 | CGGT | TAGCTGGAGGACAGTACTCA | 19899 | SpyCas9-3var-NRRH | 64 | 0 |
| 749 | CGCC | TCCCAGCTTGCACTGGTTTC | 19900 | SpyCas9-3var-NRCH | 64 | 0 |
| 750 | ACGG | GGTAGCTGGAGGACAGTACTC | 19901 | SauriCas9 | 65 | 0 |
| 751 | ACGG | GGTAGCTGGAGGACAGTACTC | 19902 | SauriCas9-KKH | 65 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 752 | ACG | GTAGCTGGAGGACAGTACTC | 19903 | ScaCas9 | 65 | 0 |
| 753 | ACG | GTAGCTGGAGGACAGTACTC | 19904 | ScaCas9-HiFi-Sc++ | 65 | 0 |
| 754 | ACG | GTAGCTGGAGGACAGTACTC | 19905 | ScaCas9-Sc++ | 65 | 0 |
| 755 | ACG | GTAGCTGGAGGACAGTACTC | 19906 | SpyCas9-SpRY | 65 | 0 |
| 756 | CCG | ATCCCAGCTTGCACTGGTTT | 19907 | ScaCas9 | 65 | 0 |
| 757 | CCG | ATCCCAGCTTGCACTGGTTT | 19908 | ScaCas9-HiFi-Sc++ | 65 | 0 |
| 758 | CCG | ATCCCAGCTTGCACTGGTTT | 19909 | ScaCas9-Sc++ | 65 | 0 |
| 759 | CCG | ATCCCAGCTTGCACTGGTTT | 19910 | SpyCas9-SpRY | 65 | 0 |
| 760 | CCGCC | ttcaTCCCAGCTTGCACTGGTTT | 19911 | BlatCas9 | 65 | 0 |
| 761 | ACGGTT | GGTAGCTGGAGGACAGTACTC | 19912 | cCas9-v16 | 65 | 0 |
| 762 | ACGGTT | GGTAGCTGGAGGACAGTACTC | 19913 | cCas9-v21 | 65 | 0 |
| 763 | CCGCCTC | TCATCCCAGCTTGCACTGGTTT | 19914 | CdiCas9 | 65 | 0 |
| 764 | TCCGCC | ttTTCATCCCAGCTTGCACTGGTT | 19915 | Nme2Cas9 | 66 | 0 |
| 765 | CACGGTT | aacTGGTAGCTGGAGGACAGTACT | 19916 | PpnCas9 | 66 | 0 |
| 766 | CACGG | TGGTAGCTGGAGGACAGTACT | 19917 | SauCas9KKH | 66 | 0 |
| 767 | CACGGT | TGGTAGCTGGAGGACAGTACT | 19918 | SauCas9KKH | 66 | 0 |
| 768 | CACGGT | TGGTAGCTGGAGGACAGTACT | 19919 | cCas9-v17 | 66 | 0 |
| 769 | CACGGT | TGGTAGCTGGAGGACAGTACT | 19920 | cCas9-v42 | 66 | 0 |
| 770 | CAC | GGTAGCTGGAGGACAGTACT | 19921 | SpyCas9-SpRY | 66 | 0 |
| 771 | TCC | CATCCCAGCTTGCACTGGTT | 19922 | SpyCas9-SpRY | 66 | 0 |
| 772 | TCCGC | tttcATCCCAGCTTGCACTGGTT | 19923 | BlatCas9 | 66 | 0 |
| 773 | TCA | TGGTAGCTGGAGGACAGTAC | 19924 | SpyCas9-SpRY | 67 | 0 |
| 774 | TTC | TCATCCCAGCTTGCACTGGT | 19925 | SpyCas9-SpRY | 67 | 0 |
| 775 | CTC | CTGGTAGCTGGAGGACAGTA | 19926 | SpyCas9-SpRY | 68 | 0 |
| 776 | TTT | TTCATCCCAGCTTGCACTGG | 19927 | SpyCas9-SpRY | 68 | 0 |
| 777 | CTCACGGT | caacTGGTAGCTGGAGGACAGTA | 19928 | BlatCas9 | 68 | 0 |
| 778 | CTCAC | caacTGGTAGCTGGAGGACAGTA | 19929 | BlatCas9 | 68 | 0 |
| 779 | TTTCC | ctttTCATCCCAGCTTGCACTGG | 19930 | BlatCas9 | 68 | 0 |
| 780 | GTTTCC | ttCTTTTCATCCCAGCTTGCACTG | 19931 | Nme2Cas9 | 69 | 0 |
| 781 | ACT | ACTGGTAGCTGGAGGACAGT | 19932 | SpyCas9-SpRY | 69 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 782 | GTT | TTTCATCCCAGCTTGCACTG | 19933 | SpyCas9-SpRY | 69 | 0 |
| 783 | GTTTC | tcttTTCATCCCAGCTTGCACTG | 19934 | BlatCas9 | 69 | 0 |
| 784 | GG | TTTTCATCCCAGCTTGCACT | 19935 | SpyCas9-NG | 70 | 0 |
| 785 | GG | TTTTCATCCCAGCTTGCACT | 19936 | SpyCas9-xCas | 70 | 0 |
| 786 | GG | TTTTCATCCCAGCTTGCACT | 19937 | SpyCas9-xCas-NG | 70 | 0 |
| 787 | TAC | AACTGGTAGCTGGAGGACAG | 19938 | SpyCas9-SpRY | 70 | 0 |
| 788 | GGT | TTTTCATCCCAGCTTGCACT | 19939 | SpyCas9-SpG | 70 | 0 |
| 789 | GGT | TTTTCATCCCAGCTTGCACT | 19940 | SpyCas9-SpRY | 70 | 0 |
| 790 | TACTC | ggcaACTGGTAGCTGGAGGACAG | 19941 | BlatCas9 | 70 | 0 |
| 791 | GGTT | TTTTCATCCCAGCTTGCACT | 19942 | SpyCas9-3var-NRTH | 70 | 0 |
| 792 | TACT | AACTGGTAGCTGGAGGACAG | 19943 | SpyCas9-3var-NRCH | 70 | 0 |
| 793 | TGG | CTTTTCATCCCAGCTTGCAC | 19944 | ScaCas9 | 71 | 0 |
| 794 | TGG | CTTTTCATCCCAGCTTGCAC | 19945 | ScaCas9-HiFi-Sc++ | 71 | 0 |
| 795 | TGG | CTTTTCATCCCAGCTTGCAC | 19946 | ScaCas9-Sc++ | 71 | 0 |
| 796 | TGG | CTTTTCATCCCAGCTTGCAC | 19947 | SpyCas9 | 71 | 0 |
| 797 | TGG | CTTTTCATCCCAGCTTGCAC | 19948 | SpyCas9-HF1 | 71 | 0 |
| 798 | TGG | CTTTTCATCCCAGCTTGCAC | 19949 | SpyCas9-SpG | 71 | 0 |
| 799 | TGG | CTTTTCATCCCAGCTTGCAC | 19950 | Spy Cas9-SpRY | 71 | 0 |
| 800 | TG | CTTTTCATCCCAGCTTGCAC | 19951 | SpyCas9-NG | 71 | 0 |
| 801 | TG | CTTTTCATCCCAGCTTGCAC | 19952 | SpyCas9-xCas | 71 | 0 |
| 802 | TG | CTTTTCATCCCAGCTTGCAC | 19953 | SpyCas9-xCas-NG | 71 | 0 |
| 803 | GTA | CAACTGGTAGCTGGAGGACA | 19954 | SpyCas9-SpRY | 71 | 0 |
| 804 | TGGTTTC | TTCTTTTCATCCCAGCTTGCAC | 19955 | CdiCas9 | 71 | 0 |
| 805 | TGGT | CTTTTCATCCCAGCTTGCAC | 19956 | SpyCas9-3var-NRRH | 71 | 0 |
| 806 | CTGG | TTCTTTTCATCCCAGCTTGCA | 19957 | SauriCas9 | 72 | 0 |
| 807 | CTGG | TTCTTTTCATCCCAGCTTGCA | 19958 | SauriCas9-KKH | 72 | 0 |
| 808 | CTG | TCTTTTCATCCCAGCTTGCA | 19959 | ScaCas9 | 72 | 0 |
| 809 | CTG | TCTTTTCATCCCAGCTTGCA | 19960 | ScaCas9-HiFi-Sc++ | 72 | 0 |
| 810 | CTG | TCTTTTCATCCCAGCTTGCA | 19961 | ScaCas9-Sc++ | 72 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 811 | CTG | TCTTTTCATCCCAGCTTGCA | 19962 | SpyCas9-SpRY | 72 | 0 |
| 812 | AG | GCAACTGGTAGCTGGAGGAC | 19963 | SpyCas9-NG | 72 | 0 |
| 813 | AG | GCAACTGGTAGCTGGAGGAC | 19964 | SpyCas9-xCas | 72 | 0 |
| 814 | AG | GCAACTGGTAGCTGGAGGAC | 19965 | SpyCas9-xCas-NG | 72 | 0 |
| 815 | AGT | GCAACTGGTAGCTGGAGGAC | 19966 | SpyCas9-SpG | 72 | 0 |
| 816 | AGT | GCAACTGGTAGCTGGAGGAC | 19967 | SpyCas9-SpRY | 72 | 0 |
| 817 | AGTAC | ctggCAACTGGTAGCTGGAGGAC | 19968 | BlatCas9 | 72 | 0 |
| 818 | CTGGTT | TTCTTTTCATCCCAGCTTGCA | 19969 | cCas9-v16 | 72 | 0 |
| 819 | CTGGTT | TTCTTTTCATCCCAGCTTGCA | 19970 | cCas9-v21 | 72 | 0 |
| 820 | AGTA | GCAACTGGTAGCTGGAGGAC | 19971 | SpyCas9-3var-NRTH | 72 | 0 |
| 821 | ACTGGTT | tttCTTCTTTTCATCCCAGCTTGC | 19972 | PpnCas9 | 73 | 0 |
| 822 | ACTGG | CTTCTTTTCATCCCAGCTTGC | 19973 | SauCas9KKH | 73 | 0 |
| 823 | ACTGGT | CTTCTTTTCATCCCAGCTTGC | 19974 | SauCas9KKH | 73 | 0 |
| 824 | CAG | GGCAACTGGTAGCTGGAGGA | 19975 | ScaCas9 | 73 | 0 |
| 825 | CAG | GGCAACTGGTAGCTGGAGGA | 19976 | ScaCas9-HiFi-Sc++ | 73 | 0 |
| 826 | CAG | GGCAACTGGTAGCTGGAGGA | 19977 | ScaCas9-Sc++ | 73 | 0 |
| 827 | CAG | GGCAACTGGTAGCTGGAGGA | 19978 | SpyCas9-SpRY | 73 | 0 |
| 828 | ACT | TTCTTTTCATCCCAGCTTGC | 19979 | SpyCas9-SpRY | 73 | 0 |
| 829 | CAGTACT | CTGGCAACTGGTAGCTGGAGGA | 19980 | CdiCas9 | 73 | 0 |
| 830 | ACTGGTTT | tttcTTCTTTTCATCCCAGCTTGC | 19981 | NmeCas9 | 73 | 0 |
| 831 | CAGT | GGCAACTGGTAGCTGGAGGA | 19982 | SpyCas9-3var-NRRH | 73 | 0 |
| 832 | ACAG | CTGGCAACTGGTAGCTGGAGG | 19983 | SauriCas9-KKH | 74 | 0 |
| 833 | CAC | CTTCTTTTCATCCCAGCTTG | 19984 | SpyCas9-SpRY | 74 | 0 |
| 834 | ACA | TGGCAACTGGTAGCTGGAGG | 19985 | SpyCas9-SpRY | 74 | 0 |
| 835 | CACT | CTTCTTTTCATCCCAGCTTG | 19986 | SpyCas9-3var-NRCH | 74 | 0 |
| 836 | GACAG | CCTGGCAACTGGTAGCTGGAG | 19987 | SauCas9KKH | 75 | 0 |
| 837 | GACAGT | CCTGGCAACTGGTAGCTGGAG | 19988 | SauCas9KKH | 75 | 0 |
| 838 | GACAGT | CCTGGCAACTGGTAGCTGGAG | 19989 | cCas9-v17 | 75 | 0 |
| 839 | GACAGT | CCTGGCAACTGGTAGCTGGAG | 19990 | cCas9-v42 | 75 | 0 |
| 840 | GAC | CTGGCAACTGGTAGCTGGAG | 19991 | SpyCas9-SpRY | 75 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 841 | GCA | TCTTCTTTTCATCCCAGCTT | 19992 | SpyCas9-SpRY | 75 | 0 |
| 842 | GACAGTAC | tgCCTGGCAACTGGTAGCTGGAG | 19993 | CjeCas9 | 75 | 0 |
| 843 | GACA | CTGGCAACTGGTAGCTGGAG | 19994 | SpyCas9-3var-NRCH | 75 | 0 |
| 844 | GG | CCTGGCAACTGGTAGCTGGA | 19995 | SpyCas9-NG | 76 | 0 |
| 845 | GG | CCTGGCAACTGGTAGCTGGA | 19996 | SpyCas9-xCas | 76 | 0 |
| 846 | GG | CCTGGCAACTGGTAGCTGGA | 19997 | SpyCas9-xCas-NG | 76 | 0 |
| 847 | TG | TTCTTCTTTTCATCCCAGCT | 19998 | SpyCas9-NG | 76 | 0 |
| 848 | TG | TTCTTCTTTTCATCCCAGCT | 19999 | SpyCas9-xCas | 76 | 0 |
| 849 | TG | TTCTTCTTTTCATCCCAGCT | 20000 | SpyCas9-xCas-NG | 76 | 0 |
| 850 | GGA | CCTGGCAACTGGTAGCTGGA | 20001 | SpyCas9-SpG | 76 | 0 |
| 851 | GGA | CCTGGCAACTGGTAGCTGGA | 20002 | SpyCas9-SpRY | 76 | 0 |
| 852 | TGC | TTCTTCTTTTCATCCCAGCT | 20003 | SpyCas9-SpG | 76 | 0 |
| 853 | TGC | TTCTTCTTTTCATCCCAGCT | 20004 | SpyCas9-SpRY | 76 | 0 |
| 854 | TGCACTGG | tcttTCTTCTTTTCATCCCAGCT | 20005 | BlatCas9 | 76 | 0 |
| 855 | TGCAC | tcttTCTTCTTTTCATCCCAGCT | 20006 | BlatCas9 | 76 | 0 |
| 856 | TGCACT | TTTCTTCTTTTCATCCCAGCT | 20007 | cCas9-v16 | 76 | 0 |
| 857 | TGCACT | TTTCTTCTTTTCATCCCAGCT | 20008 | cCas9-v21 | 76 | 0 |
| 858 | GGAC | CCTGGCAACTGGTAGCTGGA | 20009 | SpyCas9-3var-NRRH | 76 | 0 |
| 859 | GGAC | CCTGGCAACTGGTAGCTGGA | 20010 | SpyCas9-VQR | 76 | 0 |
| 860 | TGCA | TTCTTCTTTTCATCCCAGCT | 20011 | SpyCas9-3var-NRCH | 76 | 0 |
| 861 | AGG | GCCTGGCAACTGGTAGCTGG | 20012 | ScaCas9 | 77 | 0 |
| 862 | AGG | GCCTGGCAACTGGTAGCTGG | 20013 | ScaCas9-HiFi-Sc++ | 77 | 0 |
| 863 | AGG | GCCTGGCAACTGGTAGCTGG | 20014 | ScaCas9-Sc++ | 77 | 0 |
| 864 | AGG | GCCTGGCAACTGGTAGCTGG | 20015 | SpyCas9 | 77 | 0 |
| 865 | AGG | GCCTGGCAACTGGTAGCTGG | 20016 | SpyCas9-HF1 | 77 | 0 |
| 866 | AGG | GCCTGGCAACTGGTAGCTGG | 20017 | SpyCas9-SpG | 77 | 0 |
| 867 | AGG | GCCTGGCAACTGGTAGCTGG | 20018 | SpyCas9-SpRY | 77 | 0 |
| 868 | TTG | TTTCTTCTTTTCATCCCAGC | 20019 | ScaCas9 | 77 | 0 |
| 869 | TTG | TTTCTTCTTTTCATCCCAGC | 20020 | ScaCas9-HiFi-Sc++ | 77 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 870 | TTG | TTTCTTCTTTTCATCCCAGC | 20021 | ScaCas9-Sc++ | 77 | 0 |
| 871 | TTG | TTTCTTCTTTTCATCCCAGC | 20022 | SpyCas9-SpRY | 77 | 0 |
| 872 | AG | GCCTGGCAACTGGTAGCTGG | 20023 | SpyCas9-NG | 77 | 0 |
| 873 | AG | GCCTGGCAACTGGTAGCTGG | 20024 | SpyCas9-xCas | 77 | 0 |
| 874 | AG | GCCTGGCAACTGGTAGCTGG | 20025 | SpyCas9-xCas-NG | 77 | 0 |
| 875 | AGGACAGT | tgtgCCTGGCAACTGGTAGCTGG | 20026 | BlatCas9 | 77 | 0 |
| 876 | AGGAC | tgtgCCTGGCAACTGGTAGCTGG | 20027 | BlatCas9 | 77 | 0 |
| 877 | TTGCACT | TCTTTCTTCTTTTCATCCCAGC | 20028 | CdiCas9 | 77 | 0 |
| 878 | AGGA | GCCTGGCAACTGGTAGCTGG | 20029 | SpyCas9-3var-NRRH | 77 | 0 |
| 879 | GAGGA | ttGTGCCTGGCAACTGGTAGCTG | 20030 | SauCas9 | 78 | 0 |
| 880 | GAGGA | GTGCCTGGCAACTGGTAGCTG | 20031 | SauCas9KKH | 78 | 0 |
| 881 | GAGG | GTGCCTGGCAACTGGTAGCTG | 20032 | SauriCas9 | 78 | 0 |
| 882 | GAGG | GTGCCTGGCAACTGGTAGCTG | 20033 | SauriCas9-KKH | 78 | 0 |
| 883 | GAG | TGCCTGGCAACTGGTAGCTG | 20034 | ScaCas9 | 78 | 0 |
| 884 | GAG | TGCCTGGCAACTGGTAGCTG | 20035 | ScaCas9-HiFi-Sc++ | 78 | 0 |
| 885 | GAG | TGCCTGGCAACTGGTAGCTG | 20036 | ScaCas9-Sc++ | 78 | 0 |
| 886 | GAG | TGCCTGGCAACTGGTAGCTG | 20037 | SpyCas9-SpRY | 78 | 0 |
| 887 | CTT | CTTTCTTCTTTTCATCCCAG | 20038 | SpyCas9-SpRY | 78 | 0 |
| 888 | CTTGC | tttcTTTCTTCTTTTCATCCCAG | 20039 | BlatCas9 | 78 | 0 |
| 889 | GAGGAC | GTGCCTGGCAACTGGTAGCTG | 20040 | cCas9-v17 | 78 | 0 |
| 890 | GAGGAC | GTGCCTGGCAACTGGTAGCTG | 20041 | cCas9-v42 | 78 | 0 |
| 891 | GGAGG | TGTGCCTGGCAACTGGTAGCT | 20042 | SauCas9KKH | 79 | 0 |
| 892 | GGAG | TGTGCCTGGCAACTGGTAGCT | 20043 | SauriCas9-KKH | 79 | 0 |
| 893 | GGAG | GTGCCTGGCAACTGGTAGCT | 20044 | SpyCas9-VQR | 79 | 0 |
| 894 | GG | GTGCCTGGCAACTGGTAGCT | 20045 | SpyCas9-NG | 79 | 0 |
| 895 | GG | GTGCCTGGCAACTGGTAGCT | 20046 | SpyCas9-xCas | 79 | 0 |
| 896 | GG | GTGCCTGGCAACTGGTAGCT | 20047 | SpyCas9-xCas-NG | 79 | 0 |
| 897 | GGA | GTGCCTGGCAACTGGTAGCT | 20048 | SpyCas9-SpG | 79 | 0 |
| 898 | GGA | GTGCCTGGCAACTGGTAGCT | 20049 | SpyCas9-SpRY | 79 | 0 |
| 899 | GCT | TCTTTCTTCTTTTCATCCCA | 20050 | SpyCas9-SpRY | 79 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 900 | GGAGGA | TGTGCCTGGCAACTGGTAGCT | 20051 | cCas9-v17 | 79 | 0 |
| 901 | GGAGGA | TGTGCCTGGCAACTGGTAGCT | 20052 | cCas9-v42 | 79 | 0 |
| 902 | GCTTGCAC | ttTTCTTTCTTCTTTTCATCCCA | 20053 | CjeCas9 | 79 | 0 |
| 903 | GGAGGACA | cattGTGCCTGGCAACTGGTAGCT | 20054 | NmeCas9 | 79 | 0 |
| 904 | TGGAG | caTTGTGCCTGGCAACTGGTAGC | 20055 | SauCas9 | 80 | 0 |
| 905 | TGGAG | TTGTGCCTGGCAACTGGTAGC | 20056 | SauCas9KKH | 80 | 0 |
| 906 | TGG | TGTGCCTGGCAACTGGTAGC | 20057 | ScaCas9 | 80 | 0 |
| 907 | TGG | TGTGCCTGGCAACTGGTAGC | 20058 | ScaCas9-HiFi-Sc++ | 80 | 0 |
| 908 | TGG | TGTGCCTGGCAACTGGTAGC | 20059 | ScaCas9-Sc++ | 80 | 0 |
| 909 | TGG | TGTGCCTGGCAACTGGTAGC | 20060 | SpyCas9 | 80 | 0 |
| 910 | TGG | TGTGCCTGGCAACTGGTAGC | 20061 | SpyCas9-HF1 | 80 | 0 |
| 911 | TGG | TGTGCCTGGCAACTGGTAGC | 20062 | SpyCas9-SpG | 80 | 0 |
| 912 | TGG | TGTGCCTGGCAACTGGTAGC | 20063 | SpyCas9-SpRY | 80 | 0 |
| 913 | TG | TGTGCCTGGCAACTGGTAGC | 20064 | SpyCas9-NG | 80 | 0 |
| 914 | TG | TGTGCCTGGCAACTGGTAGC | 20065 | SpyCas9-xCas | 80 | 0 |
| 915 | TG | TGTGCCTGGCAACTGGTAGC | 20066 | SpyCas9-xCas-NG | 80 | 0 |
| 916 | AG | TTCTTTCTTCTTTTCATCCC | 20067 | SpyCas9-NG | 80 | 0 |
| 917 | AG | TTCTTTCTTCTTTTCATCCC | 20068 | SpyCas9-xCas | 80 | 0 |
| 918 | AG | TTCTTTCTTCTTTTCATCCC | 20069 | SpyCas9-xCas-NG | 80 | 0 |
| 919 | AGC | TTCTTTCTTCTTTTCATCCC | 20070 | SpyCas9-SpG | 80 | 0 |
| 920 | AGC | TTCTTTCTTCTTTTCATCCC | 20071 | SpyCas9-SpRY | 80 | 0 |
| 921 | TGGAGG | TTGTGCCTGGCAACTGGTAGC | 20072 | cCas9-v17 | 80 | 0 |
| 922 | TGGAGG | TTGTGCCTGGCAACTGGTAGC | 20073 | cCas9-v42 | 80 | 0 |
| 923 | TGGA | TGTGCCTGGCAACTGGTAGC | 20074 | SpyCas9-3var-NRRH | 80 | 0 |
| 924 | AGCT | TTCTTTCTTCTTTTCATCCC | 20075 | SpyCas9-3var-NRCH | 80 | 0 |
| 925 | CTGGA | tcATTGTGCCTGGCAACTGGTAG | 20076 | SauCas9 | 81 | 0 |
| 926 | CTGGA | ATTGTGCCTGGCAACTGGTAG | 20077 | SauCas9KKH | 81 | 0 |
| 927 | CTGG | ATTGTGCCTGGCAACTGGTAG | 20078 | SauriCas9 | 81 | 0 |
| 928 | CTGG | ATTGTGCCTGGCAACTGGTAG | 20079 | SauriCas9-KKH | 81 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 929 | CTG | TTGTGCCTGGCAACTGGTAG | 20080 | ScaCas9 | 81 | 0 |
| 930 | CTG | TTGTGCCTGGCAACTGGTAG | 20081 | ScaCas9-HiFi-Sc++ | 81 | 0 |
| 931 | CTG | TTGTGCCTGGCAACTGGTAG | 20082 | ScaCas9-Sc++ | 81 | 0 |
| 932 | CTG | TTGTGCCTGGCAACTGGTAG | 20083 | SpyCas9-SpRY | 81 | 0 |
| 933 | CAG | TTTCTTTCTTCTTTTCATCC | 20084 | ScaCas9 | 81 | 0 |
| 934 | CAG | TTTCTTTCTTCTTTTCATCC | 20085 | ScaCas9-HiFi-Sc++ | 81 | 0 |
| 935 | CAG | TTTCTTTCTTCTTTTCATCC | 20086 | ScaCas9-Sc++ | 81 | 0 |
| 936 | CAG | TTTCTTTCTTCTTTTCATCC | 20087 | SpyCas9-SpRY | 81 | 0 |
| 937 | CTGGAG | ATTGTGCCTGGCAACTGGTAG | 20088 | cCas9-v17 | 81 | 0 |
| 938 | CTGGAG | ATTGTGCCTGGCAACTGGTAG | 20089 | cCas9-v42 | 81 | 0 |
| 939 | CAGC | TTTCTTTCTTCTTTTCATCC | 20090 | SpyCas9-3var-NRRH | 81 | 0 |
| 940 | GCTGG | CATTGTGCCTGGCAACTGGTA | 20091 | SauCas9KKH | 82 | 0 |
| 941 | CCAG | GTTTTCTTTCTTCTTTTCATC | 20092 | SauriCas9-KKH | 82 | 0 |
| 942 | GCT | ATTGTGCCTGGCAACTGGTA | 20093 | SpyCas9-SpRY | 82 | 0 |
| 943 | CCA | TTTTCTTTCTTCTTTTCATC | 20094 | SpyCas9-SpRY | 82 | 0 |
| 944 | CCAGCTTG | gagtTTTCTTTCTTCTTTTCATC | 20095 | BlatCas9 | 82 | 0 |
| 945 | CCAGC | gagtTTTCTTTCTTCTTTTCATC | 20096 | BlatCas9 | 82 | 0 |
| 946 | CCAGCT | GTTTTCTTTCTTCTTTTCATC | 20097 | cCas9-v16 | 82 | 0 |
| 947 | CCAGCT | GTTTTCTTTCTTCTTTTCATC | 20098 | cCas9-v21 | 82 | 0 |
| 948 | CCCAG | AGTTTTCTTTCTTCTTTTCAT | 20099 | SauCas9KKH | 83 | 0 |
| 949 | AG | CATTGTGCCTGGCAACTGGT | 20100 | SpyCas9-NG | 83 | 0 |
| 950 | AG | CATTGTGCCTGGCAACTGGT | 20101 | SpyCas9-xCas | 83 | 0 |
| 951 | AG | CATTGTGCCTGGCAACTGGT | 20102 | SpyCas9-xCas-NG | 83 | 0 |
| 952 | AGC | CATTGTGCCTGGCAACTGGT | 20103 | SpyCas9-SpG | 83 | 0 |
| 953 | AGC | CATTGTGCCTGGCAACTGGT | 20104 | SpyCas9-SpRY | 83 | 0 |
| 954 | CCC | GTTTTCTTTCTTCTTTTCAT | 20105 | SpyCas9-SpRY | 83 | 0 |
| 955 | CCCAGC | AGTTTTCTTTCTTCTTTTCAT | 20106 | cCas9-v17 | 83 | 0 |
| 956 | CCCAGC | AGTTTTCTTTCTTCTTTTCAT | 20107 | cCas9-v42 | 83 | 0 |
| 957 | CCCAGCTT | ttgaGTTTTCTTTCTTCTTTTCAT | 20108 | NmeCas9 | 83 | 0 |
| 958 | AGCT | CATTGTGCCTGGCAACTGGT | 20109 | SpyCas9-3var-NRCH | 83 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 959 | TAG | TCATTGTGCCTGGCAACTGG | 20110 | ScaCas9 | 84 | 0 |
| 960 | TAG | TCATTGTGCCTGGCAACTGG | 20111 | ScaCas9-HiFi-Sc++ | 84 | 0 |
| 961 | TAG | TCATTGTGCCTGGCAACTGG | 20112 | ScaCas9-Sc++ | 84 | 0 |
| 962 | TAG | TCATTGTGCCTGGCAACTGG | 20113 | SpyCas9-SpRY | 84 | 0 |
| 963 | TCC | AGTTTTCTTTCTTCTTTTCA | 20114 | SpyCas9-SpRY | 84 | 0 |
| 964 | TAGC | TCATTGTGCCTGGCAACTGG | 20115 | SpyCas9-3var-NRRH | 84 | 0 |
| 965 | GTAG | GCTCATTGTGCCTGGCAACTG | 20116 | SauriCas9-KKH | 85 | 0 |
| 966 | GTA | CTCATTGTGCCTGGCAACTG | 20117 | SpyCas9-SpRY | 85 | 0 |
| 967 | ATC | GAGTTTTCTTTCTTCTTTTC | 20118 | Spy Cas9-SpRY | 85 | 0 |
| 968 | GTAGCTGG | gcgcTCATTGTGCCTGGCAACTG | 20119 | BlatCas9 | 85 | 0 |
| 969 | GTAGC | gcgcTCATTGTGCCTGGCAACTG | 20120 | BlatCas9 | 85 | 0 |
| 970 | ATCCC | tttgAGTTTTCTTTCTTCTTTTC | 20121 | BlatCas9 | 85 | 0 |
| 971 | GTAGCT | GCTCATTGTGCCTGGCAACTG | 20122 | cCas9-v16 | 85 | 0 |
| 972 | GTAGCT | GCTCATTGTGCCTGGCAACTG | 20123 | cCas9-v21 | 85 | 0 |
| 973 | CATCCC | gcTTTGAGTTTTCTTTCTTCTTTT | 20124 | Nme2Cas9 | 86 | 0 |
| 974 | GGTAG | CGCTCATTGTGCCTGGCAACT | 20125 | SauCas9KKH | 86 | 0 |
| 975 | GG | GCTCATTGTGCCTGGCAACT | 20126 | SpyCas9-NG | 86 | 0 |
| 976 | GG | GCTCATTGTGCCTGGCAACT | 20127 | SpyCas9-xCas | 86 | 0 |
| 977 | GG | GCTCATTGTGCCTGGCAACT | 20128 | SpyCas9-xCas-NG | 86 | 0 |
| 978 | GGT | GCTCATTGTGCCTGGCAACT | 20129 | SpyCas9-SpG | 86 | 0 |
| 979 | GGT | GCTCATTGTGCCTGGCAACT | 20130 | SpyCas9-SpRY | 86 | 0 |
| 980 | CAT | TGAGTTTTCTTTCTTCTTTT | 20131 | SpyCas9-SpRY | 86 | 0 |
| 981 | CATCCCAG | ctttGAGTTTTCTTTCTTCTTTT | 20132 | BlatCas9 | 86 | 0 |
| 982 | CATCC | ctttGAGTTTTCTTTCTTCTTTT | 20133 | BlatCas9 | 86 | 0 |
| 983 | GGTA | GCTCATTGTGCCTGGCAACT | 20134 | SpyCas9-3var-NRTH | 86 | 0 |
| 984 | CATC | TGAGTTTTCTTTCTTCTTTT | 20135 | SpyCas9-3var-NRTH | 86 | 0 |
| 985 | TCATCC | agCTTTGAGTTTTCTTTCTTCTTT | 20136 | Nme2Cas9 | 87 | 0 |
| 986 | TGG | CGCTCATTGTGCCTGGCAAC | 20137 | ScaCas9 | 87 | 0 |
| 987 | TGG | CGCTCATTGTGCCTGGCAAC | 20138 | ScaCas9-HiFi-Sc++ | 87 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 988 | TGG | CGCTCATTGTGCCTGGCAAC | 20139 | ScaCas9-Sc++ | 87 | 0 |
| 989 | TGG | CGCTCATTGTGCCTGGCAAC | 20140 | SpyCas9 | 87 | 0 |
| 990 | TGG | CGCTCATTGTGCCTGGCAAC | 20141 | SpyCas9-HF1 | 87 | 0 |
| 991 | TGG | CGCTCATTGTGCCTGGCAAC | 20142 | SpyCas9-SpG | 87 | 0 |
| 992 | TGG | CGCTCATTGTGCCTGGCAAC | 20143 | SpyCas9-SpRY | 87 | 0 |
| 993 | TG | CGCTCATTGTGCCTGGCAAC | 20144 | SpyCas9-NG | 87 | 0 |
| 994 | TG | CGCTCATTGTGCCTGGCAAC | 20145 | SpyCas9-xCas | 87 | 0 |
| 995 | TG | CGCTCATTGTGCCTGGCAAC | 20146 | SpyCas9-xCas-NG | 87 | 0 |
| 996 | TCA | TTGAGTTTTCTTTCTTCTTT | 20147 | SpyCas9-SpRY | 87 | 0 |
| 997 | TCATC | gcttTGAGTTTTCTTTCTTCTTT | 20148 | BlatCas9 | 87 | 0 |
| 998 | TCATCCC | CTTTGAGTTTTCTTTCTTCTTT | 20149 | CdiCas9 | 87 | 0 |
| 999 | TGGT | CGCTCATTGTGCCTGGCAAC | 20150 | SpyCas9-3var-NRRH | 87 | 0 |
| 1000 | CTGG | GGCGCTCATTGTGCCTGGCAA | 20151 | SauriCas9 | 88 | 0 |
| 1001 | CTGG | GGCGCTCATTGTGCCTGGCAA | 20152 | SauriCas9-KKH | 88 | 0 |
| 1002 | CTG | GCGCTCATTGTGCCTGGCAA | 20153 | ScaCas9 | 88 | 0 |
| 1003 | CTG | GCGCTCATTGTGCCTGGCAA | 20154 | ScaCas9-HiFi-Sc++ | 88 | 0 |
| 1004 | CTG | GCGCTCATTGTGCCTGGCAA | 20155 | ScaCas9-Sc++ | 88 | 0 |
| 1005 | CTG | GCGCTCATTGTGCCTGGCAA | 20156 | SpyCas9-SpRY | 88 | 0 |
| 1006 | TTC | TTTGAGTTTTCTTTCTTCTT | 20157 | SpyCas9-SpRY | 88 | 0 |
| 1007 | ACTGG | TGGCGCTCATTGTGCCTGGCA | 20158 | SauCas9KKH | 89 | 0 |
| 1008 | ACTGGT | TGGCGCTCATTGTGCCTGGCA | 20159 | SauCas9KKH | 89 | 0 |
| 1009 | ACT | GGCGCTCATTGTGCCTGGCA | 20160 | SpyCas9-SpRY | 89 | 0 |
| 1010 | TTT | CTTTGAGTTTTCTTTCTTCT | 20161 | SpyCas9-SpRY | 89 | 0 |
| 1011 | AAC | TGGCGCTCATTGTGCCTGGC | 20162 | SpyCas9-SpRY | 90 | 0 |
| 1012 | TTT | GCTTTGAGTTTTCTTTCTTC | 20163 | SpyCas9-SpRY | 90 | 0 |
| 1013 | TTTTC | tgagCTTTGAGTTTTCTTTCTTC | 20164 | BlatCas9 | 90 | 0 |
| 1014 | AACT | TGGCGCTCATTGTGCCTGGC | 20165 | SpyCas9-3var-NRCH | 90 | 0 |
| 1015 | CAA | ATGGCGCTCATTGTGCCTGG | 20166 | SpyCas9-SpRY | 91 | 0 |
| 1016 | CTT | AGCTTTGAGTTTTCTTTCTT | 20167 | SpyCas9-SpRY | 91 | 0 |
| 1017 | CAAC | ATGGCGCTCATTGTGCCTGG | 20168 | SpyCas9-3var-NRRH | 91 | 0 |

TABLE 1B-continued

Exemplary gRNA spacer Cas pairs for correcting the pathogenic R261Q mutation

Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 1018 | CAAC | gaTGGCGCTCATTGTGCCTGG | 20169 | iSpyMacCas9 | 91 | 0 |
| 1019 | GCA | GATGGCGCTCATTGTGCCTG | 20170 | SpyCas9-SpRY | 92 | 0 |
| 1020 | TCT | GAGCTTTGAGTTTTCTTTCT | 20171 | SpyCas9-SpRY | 92 | 0 |
| 1021 | GCAACTGG | aaagATGGCGCTCATTGTGCCTG | 20172 | BlatCas9 | 92 | 0 |
| 1022 | GCAAC | aaagATGGCGCTCATTGTGCCTG | 20173 | BlatCas9 | 92 | 0 |
| 1023 | GCAACT | AGATGGCGCTCATTGTGCCTG | 20174 | cCas9-v16 | 92 | 0 |
| 1024 | GCAACT | AGATGGCGCTCATTGTGCCTG | 20175 | cCas9-v21 | 92 | 0 |
| 1025 | GGCAA | AAGATGGCGCTCATTGTGCCT | 20176 | SauCas9KKH | 93 | 0 |
| 1026 | GG | AGATGGCGCTCATTGTGCCT | 20177 | SpyCas9-NG | 93 | 0 |
| 1027 | GG | AGATGGCGCTCATTGTGCCT | 20178 | SpyCas9-xCas | 93 | 0 |
| 1028 | GG | AGATGGCGCTCATTGTGCCT | 20179 | SpyCas9-xCas-NG | 93 | 0 |
| 1029 | GGC | AGATGGCGCTCATTGTGCCT | 20180 | SpyCas9-SpG | 93 | 0 |
| 1030 | GGC | AGATGGCGCTCATTGTGCCT | 20181 | SpyCas9-SpRY | 93 | 0 |
| 1031 | TTC | TGAGCTTTGAGTTTTCTTTC | 20182 | SpyCas9-SpRY | 93 | 0 |
| 1032 | GGCAAC | AAGATGGCGCTCATTGTGCCT | 20183 | cCas9-v17 | 93 | 0 |
| 1033 | GGCAAC | AAGATGGCGCTCATTGTGCCT | 20184 | cCas9-v42 | 93 | 0 |
| 1034 | GGCA | AGATGGCGCTCATTGTGCCT | 20185 | SpyCas9-3var-NRCH | 93 | 0 |
| 1035 | TGG | AAGATGGCGCTCATTGTGCC | 20186 | ScaCas9 | 94 | 0 |
| 1036 | TGG | AAGATGGCGCTCATTGTGCC | 20187 | ScaCas9-HiFi-Sc++ | 94 | 0 |
| 1037 | TGG | AAGATGGCGCTCATTGTGCC | 20188 | ScaCas9-Sc++ | 94 | 0 |
| 1038 | TGG | AAGATGGCGCTCATTGTGCC | 20189 | SpyCas9 | 94 | 0 |
| 1039 | TGG | AAGATGGCGCTCATTGTGCC | 20190 | SpyCas9-HF1 | 94 | 0 |
| 1040 | TGG | AAGATGGCGCTCATTGTGCC | 20191 | SpyCas9-SpG | 94 | 0 |
| 1041 | TGG | AAGATGGCGCTCATTGTGCC | 20192 | SpyCas9-SpRY | 94 | 0 |
| 1042 | TG | AAGATGGCGCTCATTGTGCC | 20193 | SpyCas9-NG | 94 | 0 |
| 1043 | TG | AAGATGGCGCTCATTGTGCC | 20194 | SpyCas9-xCas | 94 | 0 |
| 1044 | TG | AAGATGGCGCTCATTGTGCC | 20195 | SpyCas9-xCas-NG | 94 | 0 |
| 1045 | CTT | ATGAGCTTTGAGTTTTCTTT | 20196 | SpyCas9-SpRY | 94 | 0 |
| 1046 | TGGCAAC | AAAAGATGGCGCTCATTGTGCC | 20197 | CdiCas9 | 94 | 0 |
| 1047 | TGGC | AAGATGGCGCTCATTGTGCC | 20198 | SpyCas9-3var-NRRH | 94 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 1048 | TGGCAA | AAGATGGCGCTCATTGTGCC | 20199 | St1Cas9-LMG1831 | 94 | 0 |
| 1049 | CTGG | AAAAGATGGCGCTCATTGTGC | 20200 | SauriCas9 | 95 | 0 |
| 1050 | CTGG | AAAAGATGGCGCTCATTGTGC | 20201 | SauriCas9-KKH | 95 | 0 |
| 1051 | CTG | AAAGATGGCGCTCATTGTGC | 20202 | ScaCas9 | 95 | 0 |
| 1052 | CTG | AAAGATGGCGCTCATTGTGC | 20203 | ScaCas9-HiFi-Sc++ | 95 | 0 |
| 1053 | CTG | AAAGATGGCGCTCATTGTGC | 20204 | ScaCas9-Sc++ | 95 | 0 |
| 1054 | CTG | AAAGATGGCGCTCATTGTGC | 20205 | SpyCas9-SpRY | 95 | 0 |
| 1055 | TCT | GATGAGCTTTGAGTTTTCTT | 20206 | SpyCas9-SpRY | 95 | 0 |
| 1056 | TCTTCTTT | ggtgATGAGCTTTGAGTTTTCTT | 20207 | BlatCas9 | 95 | 0 |
| 1057 | CTGGC | ggaaAAGATGGCGCTCATTGTGC | 20208 | BlatCas9 | 95 | 0 |
| 1058 | TCTTC | ggtgATGAGCTTTGAGTTTTCTT | 20209 | BlatCas9 | 95 | 0 |
| 1059 | CCTGG | GAAAAGATGGCGCTCATTGTG | 20210 | SauCas9KKH | 96 | 0 |
| 1060 | CCT | AAAAGATGGCGCTCATTGTG | 20211 | SpyCas9-SpRY | 96 | 0 |
| 1061 | TTC | TGATGAGCTTTGAGTTTTCT | 20212 | SpyCas9-SpRY | 96 | 0 |
| 1062 | GCC | GAAAAGATGGCGCTCATTGT | 20213 | SpyCas9-SpRY | 97 | 0 |
| 1063 | TTT | GTGATGAGCTTTGAGTTTTC | 20214 | SpyCas9-SpRY | 97 | 0 |
| 1064 | TG | GGAAAAGATGGCGCTCATTG | 20215 | SpyCas9-NG | 98 | 0 |
| 1065 | TG | GGAAAAGATGGCGCTCATTG | 20216 | SpyCas9-xCas | 98 | 0 |
| 1066 | TG | GGAAAAGATGGCGCTCATTG | 20217 | SpyCas9-xCas-NG | 98 | 0 |
| 1067 | TGC | GGAAAAGATGGCGCTCATTG | 20218 | SpyCas9-SpG | 98 | 0 |
| 1068 | TGC | GGAAAAGATGGCGCTCATTG | 20219 | SpyCas9-SpRY | 98 | 0 |
| 1069 | CTT | GGTGATGAGCTTTGAGTTTT | 20220 | SpyCas9-SpRY | 98 | 0 |
| 1070 | CTTTC | agtgGTGATGAGCTTTGAGTTTT | 20221 | BlatCas9 | 98 | 0 |
| 1071 | TGCC | GGAAAAGATGGCGCTCATTG | 20222 | SpyCas9-3var-NRCH | 98 | 0 |
| 1072 | GTG | AGGAAAAGATGGCGCTCATT | 20223 | ScaCas9 | 99 | 0 |
| 1073 | GTG | AGGAAAAGATGGCGCTCATT | 20224 | ScaCas9-HiFi-Sc++ | 99 | 0 |
| 1074 | GTG | AGGAAAAGATGGCGCTCATT | 20225 | ScaCas9-Sc++ | 99 | 0 |
| 1075 | GTG | AGGAAAAGATGGCGCTCATT | 20226 | SpyCas9-SpRY | 99 | 0 |
| 1076 | TCT | TGGTGATGAGCTTTGAGTTT | 20227 | SpyCas9-SpRY | 99 | 0 |
| 1077 | GTGCCTGG | agcaGGAAAAGATGGCGCTCATT | 20228 | BlatCas9 | 99 | 0 |

TABLE 1B-continued

Exemplary gRNA spacer Cas pairs for correcting the pathogenic R261Q mutation
Table 1B provides a gRNA database for correcting the pathogenic R261Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2B, 3B, and 4B detail the other components of the system and are organized such that the ID number shown here in Column 1 ("ID") is meant to correspond to the same ID number in Tables 2B, 2B, and 4B.

| ID | PAM sequence | gRNA spacer | SEQ ID NO | Cas species | distance | Overlaps mutation |
|---|---|---|---|---|---|---|
| 1078 | GTGCC | agcaGGAAAAGATGGCGCTCATT | 20229 | BlatCas9 | 99 | 0 |
| 1079 | TGTGCC | gcAGCAGGAAAAGATGGCGCTCAT | 20230 | Nme2Cas9 | 100 | 0 |
| 1080 | TG | CAGGAAAAGATGGCGCTCAT | 20231 | SpyCas9-NG | 100 | 0 |
| 1081 | TG | CAGGAAAAGATGGCGCTCAT | 20232 | SpyCas9-xCas | 100 | 0 |
| 1082 | TG | CAGGAAAAGATGGCGCTCAT | 20233 | SpyCas9-xCas-NG | 100 | 0 |
| 1083 | TGT | CAGGAAAAGATGGCGCTCAT | 20234 | SpyCas9-SpG | 100 | 0 |
| 1084 | TGT | CAGGAAAAGATGGCGCTCAT | 20235 | SpyCas9-SpRY | 100 | 0 |
| 1085 | TTC | GTGGTGATGAGCTTTGAGTT | 20236 | SpyCas9-SpRY | 100 | 0 |
| 1086 | TGTGCCTG | cagcAGGAAAAGATGGCGCTCAT | 20237 | BlatCas9 | 100 | 0 |
| 1087 | TGTGC | cagcAGGAAAAGATGGCGCTCAT | 20238 | BlatCas9 | 100 | 0 |

TABLE 1C

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 1 | CTG | CACTGGTTTCCGCCTCCAAC | 21312 | ScaCas9 | 0 | 0 |
| 2 | CTG | CACTGGTTTCCGCCTCCAAC | 21313 | ScaCas9-HiFi-Sc++ | 0 | 0 |
| 3 | CTG | CACTGGTTTCCGCCTCCAAC | 21314 | ScaCas9-Sc++ | 0 | 0 |
| 4 | CTG | CACTGGTTTCCGCCTCCAAC | 21315 | SpyCas9-SpRY | 0 | 0 |
| 5 | GAGG | AAGCAGGCCAGCCACAGGTTG | 21316 | SauriCas9 | 1 | 0 |
| 6 | GAGG | AAGCAGGCCAGCCACAGGTTG | 21317 | SauriCas9-KKH | 1 | 0 |
| 7 | GAG | AGCAGGCCAGCCACAGGTTG | 21318 | ScaCas9 | 1 | 0 |
| 8 | GAG | AGCAGGCCAGCCACAGGTTG | 21319 | ScaCas9-HiFi-Sc++ | 1 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 9 | GAG | AGCAGGCCAGCCACAGGTTG | 21320 | ScaCas9-Sc++ | 1 | 0 |
| 10 | GAG | AGCAGGCCAGCCACAGGTTG | 21321 | SpyCas9-SpRY | 1 | 0 |
| 11 | CCT | GCACTGGTTTCCGCCTCCAA | 21322 | SpyCas9-SpRY | 1 | 0 |
| 12 | GAGGCGGA | gaaaGCAGGCCAGCCACAGGTTG | 21323 | BlatCas9 | 1 | 0 |
| 13 | GAGGC | gaaaGCAGGCCAGCCACAGGTTG | 21324 | BlatCas9 | 1 | 0 |
| 14 | GGAGG | AAAGCAGGCCAGCCACAGGTT | 21325 | SauCas9KKH | 2 | 0 |
| 15 | GGAG | AAAGCAGGCCAGCCACAGGTT | 21326 | SauriCas9-KKH | 2 | 0 |
| 16 | GGAG | AAGCAGGCCAGCCACAGGTT | 21327 | SpyCas9-VQR | 2 | 0 |
| 17 | GG | AAGCAGGCCAGCCACAGGTT | 21328 | SpyCas9-NG | 2 | 0 |
| 18 | GG | AAGCAGGCCAGCCACAGGTT | 21329 | SpyCas9-xCas | 2 | 0 |
| 19 | GG | AAGCAGGCCAGCCACAGGTT | 21330 | SpyCas9-xCas-NG | 2 | 0 |
| 20 | GGA | AAGCAGGCCAGCCACAGGTT | 21331 | SpyCas9-SpG | 2 | 0 |
| 21 | GGA | AAGCAGGCCAGCCACAGGTT | 21332 | SpyCas9-SpRY | 2 | 0 |
| 22 | ACC | TGCACTGGTTTCCGCCTCCA | 21333 | SpyCas9-SpRY | 2 | 0 |
| 23 | GGAGGC | AAAGCAGGCCAGCCACAGGTT | 21334 | cCas9-v17 | 2 | 0 |
| 24 | GGAGGC | AAAGCAGGCCAGCCACAGGTT | 21335 | cCas9-v42 | 2 | 0 |
| 25 | tGGAG | agGAAAGCAGGCCAGCCACAGGT | 21336 | SauCas9 | 3 | 1 |
| 26 | tGGAG | GAAAGCAGGCCAGCCACAGGT | 21337 | SauCas9KKH | 3 | 1 |
| 27 | tGG | AAAGCAGGCCAGCCACAGGT | 21338 | ScaCas9 | 3 | 1 |
| 28 | tGG | AAAGCAGGCCAGCCACAGGT | 21339 | ScaCas9-HiFi-Sc++ | 3 | 1 |
| 29 | tGG | AAAGCAGGCCAGCCACAGGT | 21340 | ScaCas9-Sc++ | 3 | 1 |
| 30 | tGG | AAAGCAGGCCAGCCACAGGT | 21341 | SpyCas9 | 3 | 1 |
| 31 | tGG | AAAGCAGGCCAGCCACAGGT | 21342 | SpyCas9-HF1 | 3 | 1 |
| 32 | tGG | AAAGCAGGCCAGCCACAGGT | 21343 | SpyCas9-SpG | 3 | 1 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 33 | tGG | AAAGCAGGCCAGCCACAGGT | 21344 | SpyCas9-SpRY | 3 | 1 |
| 34 | tG | AAAGCAGGCCAGCCACAGGT | 21345 | SpyCas9-NG | 3 | 1 |
| 35 | tG | AAAGCAGGCCAGCCACAGGT | 21346 | SpyCas9-xCas | 3 | 1 |
| 36 | tG | AAAGCAGGCCAGCCACAGGT | 21347 | SpyCas9-xCas-NG | 3 | 1 |
| 37 | aAC | TTGCACTGGTTTCCGCCTCC | 21348 | SpyCas9-SpRY | 3 | 1 |
| 38 | tGGAGG | GAAAGCAGGCCAGCCACAGGT | 21349 | cCas9-v17 | 3 | 1 |
| 39 | tGGAGG | GAAAGCAGGCCAGCCACAGGT | 21350 | cCas9-v42 | 3 | 1 |
| 40 | tGGA | AAAGCAGGCCAGCCACAGGT | 21351 | SpyCas9-3var-NRRH | 3 | 1 |
| 41 | aACC | TTGCACTGGTTTCCGCCTCC | 21352 | SpyCas9-3var-NRCH | 3 | 1 |
| 42 | TtGGA | gaGGAAAGCAGGCCAGCCACAGG | 21353 | SauCas9 | 4 | 1 |
| 43 | TtGGA | GGAAAGCAGGCCAGCCACAGG | 21354 | SauCas9KKH | 4 | 1 |
| 44 | TtGG | GGAAAGCAGGCCAGCCACAGG | 21355 | SauriCas9 | 4 | 1 |
| 45 | TtGG | GGAAAGCAGGCCAGCCACAGG | 21356 | SauriCas9-KKH | 4 | 1 |
| 46 | TtG | GAAAGCAGGCCAGCCACAGG | 21357 | ScaCas9 | 4 | 1 |
| 47 | TtG | GAAAGCAGGCCAGCCACAGG | 21358 | ScaCas9-HiFi-Sc++ | 4 | 1 |
| 48 | TtG | GAAAGCAGGCCAGCCACAGG | 21359 | ScaCas9-Sc++ | 4 | 1 |
| 49 | TtG | GAAAGCAGGCCAGCCACAGG | 21360 | SpyCas9-SpRY | 4 | 1 |
| 50 | CaA | CTTGCACTGGTTTCCGCCTC | 21361 | SpyCas9-SpRY | 4 | 1 |
| 51 | CaACCTGT | cagcTTGCACTGGTTTCCGCCTC | 21362 | BlatCas9 | 4 | 1 |
| 52 | CaACC | cagcTTGCACTGGTTTCCGCCTC | 21363 | BlatCas9 | 4 | 1 |
| 53 | TtGGAG | GGAAAGCAGGCCAGCCACAGG | 21364 | cCas9-v17 | 4 | 1 |
| 54 | TtGGAG | GGAAAGCAGGCCAGCCACAGG | 21365 | cCas9-v42 | 4 | 1 |
| 55 | CaAC | CTTGCACTGGTTTCCGCCTC | 21366 | SpyCas9-3var-NRRH | 4 | 1 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 56 | CaAC | gcTTGCACTGGTTTCCGCCTC | 21367 | iSpyMacCas9 | 4 | 1 |
| 57 | CCaACC | ccCAGCTTGCACTGGTTTCCGCCT | 21368 | Nme2Cas9 | 5 | 1 |
| 58 | GTtGG | AGGAAAGCAGGCCAGCCACAG | 21369 | SauCas9KKH | 5 | 1 |
| 59 | GTt | GGAAAGCAGGCCAGCCACAG | 21370 | SpyCas9-SpRY | 5 | 1 |
| 60 | CCa | GCTTGCACTGGTTTCCGCCT | 21371 | SpyCas9-SpRY | 5 | 1 |
| 61 | CCaACCTG | ccagCTTGCACTGGTTTCCGCCT | 21372 | BlatCas9 | 5 | 1 |
| 62 | CCaAC | ccagCTTGCACTGGTTTCCGCCT | 21373 | BlatCas9 | 5 | 1 |
| 63 | CCaACCT | CAGCTTGCACTGGTTTCCGCCT | 21374 | CdiCas9 | 5 | 1 |
| 64 | TCCaA | CAGCTTGCACTGGTTTCCGCC | 21375 | SauCas9KKH | 6 | 1 |
| 65 | GG | AGGAAAGCAGGCCAGCCACA | 21376 | SpyCas9-NG | 6 | 0 |
| 66 | GG | AGGAAAGCAGGCCAGCCACA | 21377 | SpyCas9-xCas | 6 | 0 |
| 67 | GG | AGGAAAGCAGGCCAGCCACA | 21378 | SpyCas9-xCas-NG | 6 | 0 |
| 68 | GGT | AGGAAAGCAGGCCAGCCACA | 21379 | SpyCas9-SpG | 6 | 0 |
| 69 | GGT | AGGAAAGCAGGCCAGCCACA | 21380 | SpyCas9-SpRY | 6 | 0 |
| 70 | TCC | AGCTTGCACTGGTTTCCGCC | 21381 | SpyCas9-SpRY | 6 | 0 |
| 71 | TCCaAC | CAGCTTGCACTGGTTTCCGCC | 21382 | cCas9-v17 | 6 | 1 |
| 72 | TCCaAC | CAGCTTGCACTGGTTTCCGCC | 21383 | cCas9-v42 | 6 | 1 |
| 73 | GGTt | AGGAAAGCAGGCCAGCCACA | 21384 | SpyCas9-3var-NRTH | 6 | 1 |
| 74 | AGG | GAGGAAAGCAGGCCAGCCAC | 21385 | ScaCas9 | 7 | 0 |
| 75 | AGG | GAGGAAAGCAGGCCAGCCAC | 21386 | ScaCas9-HiFi-Sc++ | 7 | 0 |
| 76 | AGG | GAGGAAAGCAGGCCAGCCAC | 21387 | ScaCas9-Sc++ | 7 | 0 |
| 77 | AGG | GAGGAAAGCAGGCCAGCCAC | 21388 | SpyCas9 | 7 | 0 |
| 78 | AGG | GAGGAAAGCAGGCCAGCCAC | 21389 | SpyCas9-HF1 | 7 | 0 |
| 79 | AGG | GAGGAAAGCAGGCCAGCCAC | 21390 | SpyCas9-SpG | 7 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 80 | AGG | GAGGAAAGCAGGCCAGCCAC | 21391 | SpyCas9-SpRY | 7 | 0 |
| 81 | AG | GAGGAAAGCAGGCCAGCCAC | 21392 | SpyCas9-NG | 7 | 0 |
| 82 | AG | GAGGAAAGCAGGCCAGCCAC | 21393 | SpyCas9-xCas | 7 | 0 |
| 83 | AG | GAGGAAAGCAGGCCAGCCAC | 21394 | SpyCas9-xCas-NG | 7 | 0 |
| 84 | CTC | CAGCTTGCACTGGTTTCCGC | 21395 | SpyCas9-SpRY | 7 | 0 |
| 85 | AGGT | GAGGAAAGCAGGCCAGCCAC | 21396 | SpyCas9-3var-NRRH | 7 | 0 |
| 86 | CAGG | GAGAGGAAAGCAGGCCAGCCA | 21397 | SauriCas9 | 8 | 0 |
| 87 | CAGG | GAGAGGAAAGCAGGCCAGCCA | 21398 | SauriCas9-KKH | 8 | 0 |
| 88 | CAG | AGAGGAAAGCAGGCCAGCCA | 21399 | ScaCas9 | 8 | 0 |
| 89 | CAG | AGAGGAAAGCAGGCCAGCCA | 21400 | ScaCas9-HiFi-Sc++ | 8 | 0 |
| 90 | CAG | AGAGGAAAGCAGGCCAGCCA | 21401 | ScaCas9-Sc++ | 8 | 0 |
| 91 | CAG | AGAGGAAAGCAGGCCAGCCA | 21402 | SpyCas9-SpRY | 8 | 0 |
| 92 | CCT | CCAGCTTGCACTGGTTTCCG | 21403 | SpyCas9-SpRY | 8 | 0 |
| 93 | CCTCC | atccCAGCTTGCACTGGTTTCCG | 21404 | BlatCas9 | 8 | 0 |
| 94 | CAGGTt | GAGAGGAAAGCAGGCCAGCCA | 21405 | cCas9-v16 | 8 | 1 |
| 95 | CAGGTt | GAGAGGAAAGCAGGCCAGCCA | 21406 | cCas9-v21 | 8 | 1 |
| 96 | GCCTCC | tcATCCCAGCTTGCACTGGTTTCC | 21407 | Nme2Cas9 | 9 | 0 |
| 97 | ACAGGTt | tccCGAGAGGAAAGCAGGCCAGCC | 21408 | PpnCas9 | 9 | 1 |
| 98 | ACAGG | CGAGAGGAAAGCAGGCCAGCC | 21409 | SauCas9KKH | 9 | 0 |
| 99 | ACAGGT | CGAGAGGAAAGCAGGCCAGCC | 21410 | SauCas9KKH | 9 | 0 |
| 100 | ACAGGT | CGAGAGGAAAGCAGGCCAGCC | 21411 | cCas9-v17 | 9 | 0 |
| 101 | ACAGGT | CGAGAGGAAAGCAGGCCAGCC | 21412 | cCas9-v42 | 9 | 0 |
| 102 | ACAG | CGAGAGGAAAGCAGGCCAGCC | 21413 | SauriCas9-KKH | 9 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 103 | ACA | GAGAGGAAAGCAGGCCAGCC | 21414 | SpyCas9-SpRY | 9 | 0 |
| 104 | GCC | CCCAGCTTGCACTGGTTTCC | 21415 | SpyCas9-SpRY | 9 | 0 |
| 105 | GCCTCCaA | catcCCAGCTTGCACTGGTTTCC | 21416 | BlatCas9 | 9 | 1 |
| 106 | GCCTCCaA | catcCCAGCTTGCACTGGTTTCC | 21417 | BlatCas9 | 9 | 1 |
| 107 | GCCTC | catcCCAGCTTGCACTGGTTTCC | 21418 | BlatCas9 | 9 | 0 |
| 108 | CACAG | CCGAGAGGAAAGCAGGCCAGC | 21419 | SauCas9KKH | 10 | 0 |
| 109 | CG | TCCCAGCTTGCACTGGTTTC | 21420 | SpyCas9-NG | 10 | 0 |
| 110 | CG | TCCCAGCTTGCACTGGTTTC | 21421 | SpyCas9-xCas | 10 | 0 |
| 111 | CG | TCCCAGCTTGCACTGGTTTC | 21422 | SpyCas9-xCas-NG | 10 | 0 |
| 112 | CAC | CGAGAGGAAAGCAGGCCAGC | 21423 | SpyCas9-SpRY | 10 | 0 |
| 113 | CGC | TCCCAGCTTGCACTGGTTTC | 21424 | SpyCas9-SpG | 10 | 0 |
| 114 | CGC | TCCCAGCTTGCACTGGTTTC | 21425 | SpyCas9-SpRY | 10 | 0 |
| 115 | CACAGG | CCGAGAGGAAAGCAGGCCAGC | 21426 | cCas9-v17 | 10 | 0 |
| 116 | CACAGG | CCGAGAGGAAAGCAGGCCAGC | 21427 | cCas9-v42 | 10 | 0 |
| 117 | CACA | CGAGAGGAAAGCAGGCCAGC | 21428 | SpyCas9-3var-NRCH | 10 | 0 |
| 118 | CGCC | TCCCAGCTTGCACTGGTTTC | 21429 | SpyCas9-3var-NRCH | 10 | 0 |
| 119 | CCG | ATCCCAGCTTGCACTGGTTT | 21430 | ScaCas9 | 11 | 0 |
| 120 | CCG | ATCCCAGCTTGCACTGGTTT | 21431 | ScaCas9-HiFi-Sc++ | 11 | 0 |
| 121 | CCG | ATCCCAGCTTGCACTGGTTT | 21432 | ScaCas9-Sc++ | 11 | 0 |
| 122 | CCG | ATCCCAGCTTGCACTGGTTT | 21433 | SpyCas9-SpRY | 11 | 0 |
| 123 | CCA | CCGAGAGGAAAGCAGGCCAG | 21434 | SpyCas9-SpRY | 11 | 0 |
| 124 | CCGCC | ttcaTCCCAGCTTGCACTGGTTT | 21435 | BlatCas9 | 11 | 0 |
| 125 | CCGCCTC | TCATCCCAGCTTGCACTGGTTT | 21436 | CdiCas9 | 11 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 126 | TCCGCC | ttTTCATCCCAGCTTGCACTGGTT | 21437 | Nme2Cas9 | 12 | 0 |
| 127 | GCC | CCCGAGAGGAAAGCAGGCCA | 21438 | SpyCas9-SpRY | 12 | 0 |
| 128 | TCC | CATCCCAGCTTGCACTGGTT | 21439 | SpyCas9-SpRY | 12 | 0 |
| 129 | GCCACAGG | aatcCCGAGAGGAAAGCAGGCCA | 21440 | BlatCas9 | 12 | 0 |
| 130 | GCCAC | aatcCCGAGAGGAAAGCAGGCCA | 21441 | BlatCas9 | 12 | 0 |
| 131 | TCCGC | tttcATCCCAGCTTGCACTGGTT | 21442 | BlatCas9 | 12 | 0 |
| 132 | AG | TCCCGAGAGGAAAGCAGGCC | 21443 | SpyCas9-NG | 13 | 0 |
| 133 | AG | TCCCGAGAGGAAAGCAGGCC | 21444 | SpyCas9-xCas | 13 | 0 |
| 134 | AG | TCCCGAGAGGAAAGCAGGCC | 21445 | SpyCas9-xCas-NG | 13 | 0 |
| 135 | AGC | TCCCGAGAGGAAAGCAGGCC | 21446 | SpyCas9-SpG | 13 | 0 |
| 136 | AGC | TCCCGAGAGGAAAGCAGGCC | 21447 | SpyCas9-SpRY | 13 | 0 |
| 137 | TTC | TCATCCCAGCTTGCACTGGT | 21448 | SpyCas9-SpRY | 13 | 0 |
| 138 | AGCC | TCCCGAGAGGAAAGCAGGCC | 21449 | SpyCas9-3var-NRCH | 13 | 0 |
| 139 | CAG | ATCCCGAGAGGAAAGCAGGC | 21450 | ScaCas9 | 14 | 0 |
| 140 | CAG | ATCCCGAGAGGAAAGCAGGC | 21451 | ScaCas9-HiFi-Sc++ | 14 | 0 |
| 141 | CAG | ATCCCGAGAGGAAAGCAGGC | 21452 | ScaCas9-Sc++ | 14 | 0 |
| 142 | CAG | ATCCCGAGAGGAAAGCAGGC | 21453 | SpyCas9-SpRY | 14 | 0 |
| 143 | TTT | TTCATCCCAGCTTGCACTGG | 21454 | SpyCas9-SpRY | 14 | 0 |
| 144 | CAGCC | gaaaTCCCGAGAGGAAAGCAGGC | 21455 | BlatCas9 | 14 | 0 |
| 145 | TTTCC | ctttTCATCCCAGCTTGCACTGG | 21456 | BlatCas9 | 14 | 0 |
| 146 | CAGCCAC | AAATCCCGAGAGGAAAGCAGGC | 21457 | CdiCas9 | 14 | 0 |
| 147 | CAGC | ATCCCGAGAGGAAAGCAGGC | 21458 | SpyCas9-3var-NRRH | 14 | 0 |
| 148 | CCAGCC | aaGAAATCCCGAGAGGAAAGCAGG | 21459 | Nme2Cas9 | 15 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 149 | GTTTCC | ttCTTTTCATCCCAGCTTGCACTG | 21460 | Nme2Cas9 | 15 | 0 |
| 150 | CCAG | AAATCCCGAGAGGAAAGCAGG | 21461 | SauriCas9-KKH | 15 | 0 |
| 151 | CCA | AATCCCGAGAGGAAAGCAGG | 21462 | SpyCas9-SpRY | 15 | 0 |
| 152 | GTT | TTTCATCCCAGCTTGCACTG | 21463 | SpyCas9-SpRY | 15 | 0 |
| 153 | CCAGC | agaaATCCCGAGAGGAAAGCAGG | 21464 | BlatCas9 | 15 | 0 |
| 154 | GTTTC | tcttTTCATCCCAGCTTGCACTG | 21465 | BlatCas9 | 15 | 0 |
| 155 | GCCAG | GAAATCCCGAGAGGAAAGCAG | 21466 | SauCas9KKH | 16 | 0 |
| 156 | GG | TTTTCATCCCAGCTTGCACT | 21467 | SpyCas9-NG | 16 | 0 |
| 157 | GG | TTTTCATCCCAGCTTGCACT | 21468 | SpyCas9-xCas | 16 | 0 |
| 158 | GG | TTTTCATCCCAGCTTGCACT | 21469 | SpyCas9-xCas-NG | 16 | 0 |
| 159 | GGT | TTTTCATCCCAGCTTGCACT | 21470 | SpyCas9-SpG | 16 | 0 |
| 160 | GGT | TTTTCATCCCAGCTTGCACT | 21471 | SpyCas9-SpRY | 16 | 0 |
| 161 | GCC | AAATCCCGAGAGGAAAGCAG | 21472 | SpyCas9-SpRY | 16 | 0 |
| 162 | GCCAGC | GAAATCCCGAGAGGAAAGCAG | 21473 | cCas9-v17 | 16 | 0 |
| 163 | GCCAGC | GAAATCCCGAGAGGAAAGCAG | 21474 | cCas9-v42 | 16 | 0 |
| 164 | GGTT | TTTTCATCCCAGCTTGCACT | 21475 | SpyCas9-3var-NRTH | 16 | 0 |
| 165 | TGG | CTTTTCATCCCAGCTTGCAC | 21476 | ScaCas9 | 17 | 0 |
| 166 | TGG | CTTTTCATCCCAGCTTGCAC | 21477 | ScaCas9-HiFi-Sc++ | 17 | 0 |
| 167 | TGG | CTTTTCATCCCAGCTTGCAC | 21478 | ScaCas9-Sc++ | 17 | 0 |
| 168 | TGG | CTTTTCATCCCAGCTTGCAC | 21479 | SpyCas9 | 17 | 0 |
| 169 | TGG | CTTTTCATCCCAGCTTGCAC | 21480 | SpyCas9-HF1 | 17 | 0 |
| 170 | TGG | CTTTTCATCCCAGCTTGCAC | 21481 | SpyCas9-SpG | 17 | 0 |
| 171 | TGG | CTTTTCATCCCAGCTTGCAC | 21482 | SpyCas9-SpRY | 17 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 172 | GG | GAAATCCCGAGAGGAAAGCA | 21483 | SpyCas9-NG | 17 | 0 |
| 173 | GG | GAAATCCCGAGAGGAAAGCA | 21484 | SpyCas9-xCas | 17 | 0 |
| 174 | GG | GAAATCCCGAGAGGAAAGCA | 21485 | SpyCas9-xCas-NG | 17 | 0 |
| 175 | TG | CTTTTCATCCCAGCTTGCAC | 21486 | SpyCas9-NG | 17 | 0 |
| 176 | TG | CTTTTCATCCCAGCTTGCAC | 21487 | SpyCas9-xCas | 17 | 0 |
| 177 | TG | CTTTTCATCCCAGCTTGCAC | 21488 | SpyCas9-xCas-NG | 17 | 0 |
| 178 | GGC | GAAATCCCGAGAGGAAAGCA | 21489 | SpyCas9-SpG | 17 | 0 |
| 179 | GGC | GAAATCCCGAGAGGAAAGCA | 21490 | SpyCas9-SpRY | 17 | 0 |
| 180 | TGGTTTC | TTCTTTTCATCCCAGCTTGCAC | 21491 | CdiCas9 | 17 | 0 |
| 181 | TGGT | CTTTTCATCCCAGCTTGCAC | 21492 | SpyCas9-3var-NRRH | 17 | 0 |
| 182 | GGCC | GAAATCCCGAGAGGAAAGCA | 21493 | SpyCas9-3var-NRCH | 17 | 0 |
| 183 | CTGG | TTCTTTTCATCCCAGCTTGCA | 21494 | SauriCas9 | 18 | 0 |
| 184 | CTGG | TTCTTTTCATCCCAGCTTGCA | 21495 | SauriCas9-KKH | 18 | 0 |
| 185 | AGG | AGAAATCCCGAGAGGAAAGC | 21496 | ScaCas9 | 18 | 0 |
| 186 | AGG | AGAAATCCCGAGAGGAAAGC | 21497 | ScaCas9-HiFi-Sc++ | 18 | 0 |
| 187 | AGG | AGAAATCCCGAGAGGAAAGC | 21498 | ScaCas9-Sc++ | 18 | 0 |
| 188 | AGG | AGAAATCCCGAGAGGAAAGC | 21499 | SpyCas9 | 18 | 0 |
| 189 | AGG | AGAAATCCCGAGAGGAAAGC | 21500 | SpyCas9-HF1 | 18 | 0 |
| 190 | AGG | AGAAATCCCGAGAGGAAAGC | 21501 | SpyCas9-SpG | 18 | 0 |
| 191 | AGG | AGAAATCCCGAGAGGAAAGC | 21502 | SpyCas9-SpRY | 18 | 0 |
| 192 | CTG | TCTTTTCATCCCAGCTTGCA | 21503 | ScaCas9 | 18 | 0 |
| 193 | CTG | TCTTTTCATCCCAGCTTGCA | 21504 | ScaCas9-HiFi-Sc++ | 18 | 0 |
| 194 | CTG | TCTTTTCATCCCAGCTTGCA | 21505 | ScaCas9-Sc++ | 18 | 0 |
| 195 | CTG | TCTTTTCATCCCAGCTTGCA | 21506 | SpyCas9-SpRY | 18 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 196 | AG | AGAAATCCCGAGAGGAAAGC | 21507 | SpyCas9-NG | 18 | 0 |
| 197 | AG | AGAAATCCCGAGAGGAAAGC | 21508 | SpyCas9-xCas | 18 | 0 |
| 198 | AG | AGAAATCCCGAGAGGAAAGC | 21509 | SpyCas9-xCas-NG | 18 | 0 |
| 199 | AGGCC | ccaaGAAATCCCGAGAGGAAAGC | 21510 | BlatCas9 | 18 | 0 |
| 200 | CTGGTT | TTCTTTTCATCCCAGCTTGCA | 21511 | cCas9-v16 | 18 | 0 |
| 201 | CTGGTT | TTCTTTTCATCCCAGCTTGCA | 21512 | cCas9-v21 | 18 | 0 |
| 202 | AGGC | AGAAATCCCGAGAGGAAAGC | 21513 | SpyCas9-3var-NRRH | 18 | 0 |
| 203 | CAGGCC | acCCAAGAAATCCCGAGAGGAAAG | 21514 | Nme2Cas9 | 19 | 0 |
| 204 | ACTGGTT | tttCTTCTTTTCATCCCAGCTTGC | 21515 | PpnCas9 | 19 | 0 |
| 205 | ACTGG | CTTCTTTTCATCCCAGCTTGC | 21516 | SauCas9KKH | 19 | 0 |
| 206 | ACTGGT | CTTCTTTTCATCCCAGCTTGC | 21517 | SauCas9KKH | 19 | 0 |
| 207 | CAGG | CAAGAAATCCCGAGAGGAAAG | 21518 | SauriCas9 | 19 | 0 |
| 208 | CAGG | CAAGAAATCCCGAGAGGAAAG | 21519 | SauriCas9-KKH | 19 | 0 |
| 209 | CAG | AAGAAATCCCGAGAGGAAAG | 21520 | ScaCas9 | 19 | 0 |
| 210 | CAG | AAGAAATCCCGAGAGGAAAG | 21521 | ScaCas9-HiFi-Sc++ | 19 | 0 |
| 211 | CAG | AAGAAATCCCGAGAGGAAAG | 21522 | ScaCas9-Sc++ | 19 | 0 |
| 212 | CAG | AAGAAATCCCGAGAGGAAAG | 21523 | SpyCas9-SpRY | 19 | 0 |
| 213 | ACT | TTCTTTTCATCCCAGCTTGC | 21524 | SpyCas9-SpRY | 19 | 0 |
| 214 | CAGGCCAG | cccaAGAAATCCCGAGAGGAAAG | 21525 | BlatCas9 | 19 | 0 |
| 215 | CAGGC | cccaAGAAATCCCGAGAGGAAAG | 21526 | BlatCas9 | 19 | 0 |
| 216 | ACTGGTTT | tttcTTCTTTTCATCCCAGCTTGC | 21527 | NmeCas9 | 19 | 0 |
| 217 | GCAGG | CCAAGAAATCCCGAGAGGAAA | 21528 | SauCas9KKH | 20 | 0 |
| 218 | GCAG | CCAAGAAATCCCGAGAGGAAA | 21529 | SauriCas9-KKH | 20 | 0 |
| 219 | CAC | CTTCTTTTCATCCCAGCTTG | 21530 | SpyCas9-SpRY | 20 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 220 | GCA | CAAGAAATCCCGAGAGGAAA | 21531 | SpyCas9-SpRY | 20 | 0 |
| 221 | GCAGGC | CCAAGAAATCCCGAGAGGAAA | 21532 | cCas9-v17 | 20 | 0 |
| 222 | GCAGGC | CCAAGAAATCCCGAGAGGAAA | 21533 | cCas9-v42 | 20 | 0 |
| 223 | CACT | CTTCTTTTCATCCCAGCTTG | 21534 | SpyCas9-3var-NRCH | 20 | 0 |
| 224 | AGCAG | CCCAAGAAATCCCGAGAGGAA | 21535 | SauCas9KKH | 21 | 0 |
| 225 | AG | CCAAGAAATCCCGAGAGGAA | 21536 | SpyCas9-NG | 21 | 0 |
| 226 | AG | CCAAGAAATCCCGAGAGGAA | 21537 | SpyCas9-xCas | 21 | 0 |
| 227 | AG | CCAAGAAATCCCGAGAGGAA | 21538 | SpyCas9-xCas-NG | 21 | 0 |
| 228 | AGC | CCAAGAAATCCCGAGAGGAA | 21539 | SpyCas9-SpG | 21 | 0 |
| 229 | AGC | CCAAGAAATCCCGAGAGGAA | 21540 | SpyCas9-SpRY | 21 | 0 |
| 230 | GCA | TCTTCTTTTCATCCCAGCTT | 21541 | SpyCas9-SpRY | 21 | 0 |
| 231 | AGCAGG | CCCAAGAAATCCCGAGAGGAA | 21542 | cCas9-v17 | 21 | 0 |
| 232 | AGCAGG | CCCAAGAAATCCCGAGAGGAA | 21543 | cCas9-v42 | 21 | 0 |
| 233 | AGCA | CCAAGAAATCCCGAGAGGAA | 21544 | SpyCas9-3var-NRCH | 21 | 0 |
| 234 | AAG | CCCAAGAAATCCCGAGAGGA | 21545 | ScaCas9 | 22 | 0 |
| 235 | AAG | CCCAAGAAATCCCGAGAGGA | 21546 | ScaCas9-HiFi-Sc++ | 22 | 0 |
| 236 | AAG | CCCAAGAAATCCCGAGAGGA | 21547 | ScaCas9-Sc++ | 22 | 0 |
| 237 | AAG | CCCAAGAAATCCCGAGAGGA | 21548 | SpyCas9-SpRY | 22 | 0 |
| 238 | TG | TTCTTCTTTTCATCCCAGCT | 21549 | SpyCas9-NG | 22 | 0 |
| 239 | TG | TTCTTCTTTTCATCCCAGCT | 21550 | SpyCas9-xCas | 22 | 0 |
| 240 | TG | TTCTTCTTTTCATCCCAGCT | 21551 | SpyCas9-xCas-NG | 22 | 0 |
| 241 | TGC | TTCTTCTTTTCATCCCAGCT | 21552 | SpyCas9-SpG | 22 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 242 | TGC | TTCTTCTTTTCATCCCAGCT | 21553 | SpyCas9-SpRY | 22 | 0 |
| 243 | TGCACTGG | tcttTCTTCTTTTCATCCCAGCT | 21554 | BlatCas9 | 22 | 0 |
| 244 | TGCAC | tcttTCTTCTTTTCATCCCAGCT | 21555 | BlatCas9 | 22 | 0 |
| 245 | TGCACT | TTTCTTCTTTTCATCCCAGCT | 21556 | cCas9-v16 | 22 | 0 |
| 246 | TGCACT | TTTCTTCTTTTCATCCCAGCT | 21557 | cCas9-v21 | 22 | 0 |
| 247 | AAGC | CCCAAGAAATCCCGAGAGGA | 21558 | SpyCas9-3var-NRRH | 22 | 0 |
| 248 | TGCA | TTCTTCTTTTCATCCCAGCT | 21559 | SpyCas9-3var-NRCH | 22 | 0 |
| 249 | AAAG | CACCCAAGAAATCCCGAGAGG | 21560 | SauriCas9-KKH | 23 | 0 |
| 250 | AAAG | ACCCAAGAAATCCCGAGAGG | 21561 | SpyCas9-QQR1 | 23 | 0 |
| 251 | AAAG | caCCCAAGAAATCCCGAGAGG | 21562 | iSpyMacCas9 | 23 | 0 |
| 252 | TTG | TTTCTTCTTTTCATCCCAGC | 21563 | ScaCas9 | 23 | 0 |
| 253 | TTG | TTTCTTCTTTTCATCCCAGC | 21564 | ScaCas9-HiFi-Sc++ | 23 | 0 |
| 254 | TTG | TTTCTTCTTTTCATCCCAGC | 21565 | ScaCas9-Sc++ | 23 | 0 |
| 255 | TTG | TTTCTTCTTTTCATCCCAGC | 21566 | SpyCas9-SpRY | 23 | 0 |
| 256 | AAA | ACCCAAGAAATCCCGAGAGG | 21567 | SpyCas9-SpRY | 23 | 0 |
| 257 | AAAGCAGG | gccaCCCAAGAAATCCCGAGAGG | 21568 | BlatCas9 | 23 | 0 |
| 258 | AAAGC | gccaCCCAAGAAATCCCGAGAGG | 21569 | BlatCas9 | 23 | 0 |
| 259 | TTGCACT | TCTTTCTTCTTTTCATCCCAGC | 21570 | CdiCas9 | 23 | 0 |
| 260 | GAAAG | CCACCCAAGAAATCCCGAGAG | 21571 | SauCas9KKH | 24 | 0 |
| 261 | GAA | CACCCAAGAAATCCCGAGAG | 21572 | SpyCas9-SpRY | 24 | 0 |
| 262 | GAA | CACCCAAGAAATCCCGAGAG | 21573 | SpyCas9-xCas | 24 | 0 |
| 263 | CTT | CTTTCTTCTTTTCATCCCAG | 21574 | SpyCas9-SpRY | 24 | 0 |
| 264 | CTTGC | tttcTTTCTTCTTTTCATCCCAG | 21575 | BlatCas9 | 24 | 0 |
| 265 | GAAAGC | CCACCCAAGAAATCCCGAGAG | 21576 | cCas9-v17 | 24 | 0 |
| 266 | GAAAGC | CCACCCAAGAAATCCCGAGAG | 21577 | cCas9-v42 | 24 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 267 | GAAA | CACCCAAGAAATCCCGAGAG | 21578 | SpyCas9-3var-NRRH | 24 | 0 |
| 268 | GAAA | ccACCCAAGAAATCCCGAGAG | 21579 | iSpyMacCas9 | 24 | 0 |
| 269 | GGAAA | GCCACCCAAGAAATCCCGAGA | 21580 | SauCas9KKH | 25 | 0 |
| 270 | GG | CCACCCAAGAAATCCCGAGA | 21581 | SpyCas9-NG | 25 | 0 |
| 271 | GG | CCACCCAAGAAATCCCGAGA | 21582 | SpyCas9-xCas | 25 | 0 |
| 272 | GG | CCACCCAAGAAATCCCGAGA | 21583 | SpyCas9-xCas-NG | 25 | 0 |
| 273 | GGA | CCACCCAAGAAATCCCGAGA | 21584 | SpyCas9-SpG | 25 | 0 |
| 274 | GGA | CCACCCAAGAAATCCCGAGA | 21585 | SpyCas9-SpRY | 25 | 0 |
| 275 | GCT | TCTTTCTTCTTTTCATCCCA | 21586 | SpyCas9-SpRY | 25 | 0 |
| 276 | GGAAAG | GCCACCCAAGAAATCCCGAGA | 21587 | cCas9-v17 | 25 | 0 |
| 277 | GGAAAG | GCCACCCAAGAAATCCCGAGA | 21588 | cCas9-v42 | 25 | 0 |
| 278 | GCTTGCAC | ttTTCTTTCTTCTTTTCATCCCA | 21589 | CjeCas9 | 25 | 0 |
| 279 | GGAA | CCACCCAAGAAATCCCGAGA | 21590 | SpyCas9-3var-NRRH | 25 | 0 |
| 280 | GGAA | CCACCCAAGAAATCCCGAGA | 21591 | SpyCas9-VQR | 25 | 0 |
| 281 | AGGAA | caGGCCACCCAAGAAATCCCGAG | 21592 | SauCas9 | 26 | 0 |
| 282 | AGGAA | GGCCACCCAAGAAATCCCGAG | 21593 | SauCas9KKH | 26 | 0 |
| 283 | AGG | GCCACCCAAGAAATCCCGAG | 21594 | ScaCas9 | 26 | 0 |
| 284 | AGG | GCCACCCAAGAAATCCCGAG | 21595 | ScaCas9-HiFi-Sc++ | 26 | 0 |
| 285 | AGG | GCCACCCAAGAAATCCCGAG | 21596 | ScaCas9-Sc++ | 26 | 0 |
| 286 | AGG | GCCACCCAAGAAATCCCGAG | 21597 | SpyCas9 | 26 | 0 |
| 287 | AGG | GCCACCCAAGAAATCCCGAG | 21598 | SpyCas9-HF1 | 26 | 0 |
| 288 | AGG | GCCACCCAAGAAATCCCGAG | 21599 | SpyCas9-SpG | 26 | 0 |
| 289 | AGG | GCCACCCAAGAAATCCCGAG | 21600 | SpyCas9-SpRY | 26 | 0 |
| 290 | AG | GCCACCCAAGAAATCCCGAG | 21601 | SpyCas9-NG | 26 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 291 | AG | GCCACCCAAGAAATCCCGAG | 21602 | SpyCas9-xCas | 26 | 0 |
| 292 | AG | GCCACCCAAGAAATCCCGAG | 21603 | SpyCas9-xCas-NG | 26 | 0 |
| 293 | AG | TTCTTTCTTCTTTTCATCCC | 21604 | SpyCas9-NG | 26 | 0 |
| 294 | AG | TTCTTTCTTCTTTTCATCCC | 21605 | SpyCas9-xCas | 26 | 0 |
| 295 | AG | TTCTTTCTTCTTTTCATCCC | 21606 | SpyCas9-xCas-NG | 26 | 0 |
| 296 | AGC | TTCTTTCTTCTTTTCATCCC | 21607 | SpyCas9-SpG | 26 | 0 |
| 297 | AGC | TTCTTTCTTCTTTTCATCCC | 21608 | SpyCas9-SpRY | 26 | 0 |
| 298 | AGGAAA | GCCACCCAAGAAATCCCGAG | 21609 | St1Cas9-TH1477 | 26 | 0 |
| 299 | AGGAAA | GGCCACCCAAGAAATCCCGAG | 21610 | cCas9-v17 | 26 | 0 |
| 300 | AGGAAA | GGCCACCCAAGAAATCCCGAG | 21611 | cCas9-v42 | 26 | 0 |
| 301 | AGGA | GCCACCCAAGAAATCCCGAG | 21612 | SpyCas9-3var-NRRH | 26 | 0 |
| 302 | AGCT | TTCTTTCTTCTTTTCATCCC | 21613 | SpyCas9-3var-NRCH | 26 | 0 |
| 303 | GAGGA | ccAGGCCACCCAAGAAATCCCGA | 21614 | SauCas9 | 27 | 0 |
| 304 | GAGGA | AGGCCACCCAAGAAATCCCGA | 21615 | SauCas9KKH | 27 | 0 |
| 305 | GAGG | AGGCCACCCAAGAAATCCCGA | 21616 | SauriCas9 | 27 | 0 |
| 306 | GAGG | AGGCCACCCAAGAAATCCCGA | 21617 | SauriCas9-KKH | 27 | 0 |
| 307 | GAG | GGCCACCCAAGAAATCCCGA | 21618 | ScaCas9 | 27 | 0 |
| 308 | GAG | GGCCACCCAAGAAATCCCGA | 21619 | ScaCas9-HiFi-Sc++ | 27 | 0 |
| 309 | GAG | GGCCACCCAAGAAATCCCGA | 21620 | ScaCas9-Sc++ | 27 | 0 |
| 310 | GAG | GGCCACCCAAGAAATCCCGA | 21621 | SpyCas9-SpRY | 27 | 0 |
| 311 | CAG | TTTCTTTCTTCTTTTCATCC | 21622 | ScaCas9 | 27 | 0 |
| 312 | CAG | TTTCTTTCTTCTTTTCATCC | 21623 | ScaCas9-HiFi-Sc++ | 27 | 0 |
| 313 | CAG | TTTCTTTCTTCTTTTCATCC | 21624 | ScaCas9-Sc++ | 27 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 314 | CAG | TTTCTTTCTTCTTTTCATCC | 21625 | SpyCas9-SpRY | 27 | 0 |
| 315 | GAGGAAA | GGCCACCCAAGAAATCCCGA | 21626 | St1Cas9 | 27 | 0 |
| 316 | GAGGAA | AGGCCACCCAAGAAATCCCGA | 21627 | cCas9-v17 | 27 | 0 |
| 317 | GAGGAA | AGGCCACCCAAGAAATCCCGA | 21628 | cCas9-v42 | 27 | 0 |
| 318 | CAGC | TTTCTTTCTTCTTTTCATCC | 21629 | SpyCas9-3var-NRRH | 27 | 0 |
| 319 | AGAGG | CAGGCCACCCAAGAAATCCCG | 21630 | SauCas9KKH | 28 | 0 |
| 320 | AGAG | CAGGCCACCCAAGAAATCCCG | 21631 | SauriCas9-KKH | 28 | 0 |
| 321 | AGAG | AGGCCACCCAAGAAATCCCG | 21632 | SpyCas9-VQR | 28 | 0 |
| 322 | CCAG | GTTTTCTTTCTTCTTTTCATC | 21633 | SauriCas9-KKH | 28 | 0 |
| 323 | AG | AGGCCACCCAAGAAATCCCG | 21634 | SpyCas9-NG | 28 | 0 |
| 324 | AG | AGGCCACCCAAGAAATCCCG | 21635 | SpyCas9-xCas | 28 | 0 |
| 325 | AG | AGGCCACCCAAGAAATCCCG | 21636 | SpyCas9-xCas-NG | 28 | 0 |
| 326 | AGA | AGGCCACCCAAGAAATCCCG | 21637 | SpyCas9-SpG | 28 | 0 |
| 327 | AGA | AGGCCACCCAAGAAATCCCG | 21638 | SpyCas9-SpRY | 28 | 0 |
| 328 | CCA | TTTTCTTTCTTCTTTTCATC | 21639 | SpyCas9-SpRY | 28 | 0 |
| 329 | AGAGGAA | AGGCCACCCAAGAAATCCCG | 21640 | St1Cas9 | 28 | 0 |
| 330 | CCAGCTTG | gagtTTTCTTTCTTCTTTTCATC | 21641 | BlatCas9 | 28 | 0 |
| 331 | CCAGC | gagtTTTCTTTCTTCTTTTCATC | 21642 | BlatCas9 | 28 | 0 |
| 332 | CCAGCT | GTTTTCTTTCTTCTTTTCATC | 21643 | cCas9-v16 | 28 | 0 |
| 333 | CCAGCT | GTTTTCTTTCTTCTTTTCATC | 21644 | cCas9-v21 | 28 | 0 |
| 334 | AGAGGA | CAGGCCACCCAAGAAATCCCG | 21645 | cCas9-v17 | 28 | 0 |
| 335 | AGAGGA | CAGGCCACCCAAGAAATCCCG | 21646 | cCas9-v42 | 28 | 0 |
| 336 | GAGAG | ggCCAGGCCACCCAAGAAATCCC | 21647 | SauCas9 | 29 | 0 |
| 337 | GAGAG | CCAGGCCACCCAAGAAATCCC | 21648 | SauCas9KKH | 29 | 0 |
| 338 | CCCAG | AGTTTTCTTTCTTCTTTTCAT | 21649 | SauCas9KKH | 29 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 339 | GAG | CAGGCCACCCAAGAAATCCC | 21650 | ScaCas9 | 29 | 0 |
| 340 | GAG | CAGGCCACCCAAGAAATCCC | 21651 | ScaCas9-HiFi-Sc++ | 29 | 0 |
| 341 | GAG | CAGGCCACCCAAGAAATCCC | 21652 | ScaCas9-Sc++ | 29 | 0 |
| 342 | GAG | CAGGCCACCCAAGAAATCCC | 21653 | SpyCas9-SpRY | 29 | 0 |
| 343 | CCC | GTTTTCTTTCTTCTTTTCAT | 21654 | SpyCas9-SpRY | 29 | 0 |
| 344 | GAGAGG | CCAGGCCACCCAAGAAATCCC | 21655 | cCas9-v17 | 29 | 0 |
| 345 | GAGAGG | CCAGGCCACCCAAGAAATCCC | 21656 | cCas9-v42 | 29 | 0 |
| 346 | CCCAGC | AGTTTTCTTTCTTCTTTTCAT | 21657 | cCas9-v17 | 29 | 0 |
| 347 | CCCAGC | AGTTTTCTTTCTTCTTTTCAT | 21658 | cCas9-v42 | 29 | 0 |
| 348 | CCCAGCTT | ttgaGTTTTCTTTCTTCTTTTCAT | 21659 | NmeCas9 | 29 | 0 |
| 349 | GAGA | CAGGCCACCCAAGAAATCCC | 21660 | SpyCas9-3var-NRRH | 29 | 0 |
| 350 | CGAGA | GCCAGGCCACCCAAGAAATCC | 21661 | SauCas9KKH | 30 | 0 |
| 351 | CGAG | GCCAGGCCACCCAAGAAATCC | 21662 | SauriCas9-KKH | 30 | 0 |
| 352 | CGAG | CCAGGCCACCCAAGAAATCC | 21663 | SpyCas9-VQR | 30 | 0 |
| 353 | CG | CCAGGCCACCCAAGAAATCC | 21664 | SpyCas9-NG | 30 | 0 |
| 354 | CG | CCAGGCCACCCAAGAAATCC | 21665 | SpyCas9-xCas | 30 | 0 |
| 355 | CG | CCAGGCCACCCAAGAAATCC | 21666 | SpyCas9-xCas-NG | 30 | 0 |
| 356 | CGA | CCAGGCCACCCAAGAAATCC | 21667 | SpyCas9-SpG | 30 | 0 |
| 357 | CGA | CCAGGCCACCCAAGAAATCC | 21668 | SpyCas9-SpRY | 30 | 0 |
| 358 | TCC | AGTTTTCTTTCTTCTTTTCA | 21669 | SpyCas9-SpRY | 30 | 0 |
| 359 | CGAGAG | GCCAGGCCACCCAAGAAATCC | 21670 | cCas9-v17 | 30 | 0 |
| 360 | CGAGAG | GCCAGGCCACCCAAGAAATCC | 21671 | cCas9-v42 | 30 | 0 |
| 361 | CCGAG | aaGGCCAGGCCACCCAAGAAATC | 21672 | SauCas9 | 31 | 0 |
| 362 | CCGAG | GGCCAGGCCACCCAAGAAATC | 21673 | SauCas9KKH | 31 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 363 | CCG | GCCAGGCCACCCAAGAAATC | 21674 | ScaCas9 | 31 | 0 |
| 364 | CCG | GCCAGGCCACCCAAGAAATC | 21675 | ScaCas9-HiFi-Sc++ | 31 | 0 |
| 365 | CCG | GCCAGGCCACCCAAGAAATC | 21676 | ScaCas9-Sc++ | 31 | 0 |
| 366 | CCG | GCCAGGCCACCCAAGAAATC | 21677 | SpyCas9-SpRY | 31 | 0 |
| 367 | ATC | GAGTTTTCTTTCTTCTTTTC | 21678 | SpyCas9-SpRY | 31 | 0 |
| 368 | ATCCC | tttgAGTTTTCTTTCTTCTTTTC | 21679 | BlatCas9 | 31 | 0 |
| 369 | CCGAGA | GGCCAGGCCACCCAAGAAATC | 21680 | cCas9-v17 | 31 | 0 |
| 370 | CCGAGA | GGCCAGGCCACCCAAGAAATC | 21681 | cCas9-v42 | 31 | 0 |
| 371 | CATCCC | gcTTTGAGTTTTCTTTCTTCTTTT | 21682 | Nme2Cas9 | 32 | 0 |
| 372 | CCCGA | AGGCCAGGCCACCCAAGAAAT | 21683 | SauCas9KKH | 32 | 0 |
| 373 | CAT | TGAGTTTTCTTTCTTCTTTT | 21684 | SpyCas9-SpRY | 32 | 0 |
| 374 | CCC | GGCCAGGCCACCCAAGAAAT | 21685 | SpyCas9-SpRY | 32 | 0 |
| 375 | CATCCCAG | ctttGAGTTTTCTTTCTTCTTTT | 21686 | BlatCas9 | 32 | 0 |
| 376 | CATCC | ctttGAGTTTTCTTTCTTCTTTT | 21687 | BlatCas9 | 32 | 0 |
| 377 | CCCGAG | AGGCCAGGCCACCCAAGAAAT | 21688 | cCas9-v17 | 32 | 0 |
| 378 | CCCGAG | AGGCCAGGCCACCCAAGAAAT | 21689 | cCas9-v42 | 32 | 0 |
| 379 | CATC | TGAGTTTTCTTTCTTCTTTT | 21690 | SpyCas9-3var-NRTH | 32 | 0 |
| 380 | TCATCC | agCTTTGAGTTTTCTTTCTTCTTT | 21691 | Nme2Cas9 | 33 | 0 |
| 381 | TCC | AGGCCAGGCCACCCAAGAAA | 21692 | SpyCas9-SpRY | 33 | 0 |
| 382 | TCA | TTGAGTTTTCTTTCTTCTTT | 21693 | SpyCas9-SpRY | 33 | 0 |
| 383 | TCATC | gcttTGAGTTTTCTTTCTTCTTT | 21694 | BlatCas9 | 33 | 0 |
| 384 | TCATCCC | CTTTGAGTTTTCTTTCTTCTTT | 21695 | CdiCas9 | 33 | 0 |
| 385 | ATC | AAGGCCAGGCCACCCAAGAA | 21696 | SpyCas9-SpRY | 34 | 0 |
| 386 | TTC | TTTGAGTTTTCTTTCTTCTT | 21697 | SpyCas9-SpRY | 34 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 387 | ATCCCGAG | cggaAGGCCAGGCCACCCAAGAA | 21698 | BlatCas9 | 34 | 0 |
| 388 | ATCCC | cggaAGGCCAGGCCACCCAAGAA | 21699 | BlatCas9 | 34 | 0 |
| 389 | AATCCC | ctCGGAAGGCCAGGCCACCCAAGA | 21700 | Nme2Cas9 | 35 | 0 |
| 390 | AAT | GAAGGCCAGGCCACCCAAGA | 21701 | SpyCas9-SpRY | 35 | 0 |
| 391 | TTT | CTTTGAGTTTTCTTTCTTCT | 21702 | SpyCas9-SpRY | 35 | 0 |
| 392 | AATCCCGA | tcggAAGGCCAGGCCACCCAAGA | 21703 | BlatCas9 | 35 | 0 |
| 393 | AATCC | tcggAAGGCCAGGCCACCCAAGA | 21704 | BlatCas9 | 35 | 0 |
| 394 | AATC | GAAGGCCAGGCCACCCAAGA | 21705 | SpyCas9-3var-NRTH | 35 | 0 |
| 395 | AAATCC | acTCGGAAGGCCAGGCCACCCAAG | 21706 | Nme2Cas9 | 36 | 0 |
| 396 | AAA | GGAAGGCCAGGCCACCCAAG | 21707 | SpyCas9-SpRY | 36 | 0 |
| 397 | TTT | GCTTTGAGTTTTCTTTCTTC | 21708 | SpyCas9-SpRY | 36 | 0 |
| 398 | AAATC | ctcgGAAGGCCAGGCCACCCAAG | 21709 | BlatCas9 | 36 | 0 |
| 399 | TTTTC | tgagCTTTGAGTTTTCTTTCTTC | 21710 | BlatCas9 | 36 | 0 |
| 400 | AAATCCC | TCGGAAGGCCAGGCCACCCAAG | 21711 | CdiCas9 | 36 | 0 |
| 401 | AAAT | GGAAGGCCAGGCCACCCAAG | 21712 | SpyCas9-3var-NRRH | 36 | 0 |
| 402 | AAAT | cgGAAGGCCAGGCCACCCAAG | 21713 | iSpyMacCas9 | 36 | 0 |
| 403 | GAA | CGGAAGGCCAGGCCACCCAA | 21714 | SpyCas9-SpRY | 37 | 0 |
| 404 | GAA | CGGAAGGCCAGGCCACCCAA | 21715 | SpyCas9-xCas | 37 | 0 |
| 405 | CTT | AGCTTTGAGTTTTCTTTCTT | 21716 | SpyCas9-SpRY | 37 | 0 |
| 406 | GAAATCC | CTCGGAAGGCCAGGCCACCCAA | 21717 | CdiCas9 | 37 | 0 |
| 407 | GAAA | CGGAAGGCCAGGCCACCCAA | 21718 | SpyCas9-3var-NRRH | 37 | 0 |
| 408 | GAAA | tcGGAAGGCCAGGCCACCCAA | 21719 | iSpyMacCas9 | 37 | 0 |
| 409 | AGAAA | CTCGGAAGGCCAGGCCACCCA | 21720 | SauCas9KKH | 38 | 0 |
| 410 | AGAAAT | CTCGGAAGGCCAGGCCACCCA | 21721 | SauCas9KKH | 38 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 411 | AGAAAT | CTCGGAAGGCCAGGCCACCCA | 21722 | cCas9-v17 | 38 | 0 |
| 412 | AGAAAT | CTCGGAAGGCCAGGCCACCCA | 21723 | cCas9-v42 | 38 | 0 |
| 413 | AG | TCGGAAGGCCAGGCCACCCA | 21724 | SpyCas9-NG | 38 | 0 |
| 414 | AG | TCGGAAGGCCAGGCCACCCA | 21725 | SpyCas9-xCas | 38 | 0 |
| 415 | AG | TCGGAAGGCCAGGCCACCCA | 21726 | SpyCas9-xCas-NG | 38 | 0 |
| 416 | AGA | TCGGAAGGCCAGGCCACCCA | 21727 | SpyCas9-SpG | 38 | 0 |
| 417 | AGA | TCGGAAGGCCAGGCCACCCA | 21728 | SpyCas9-SpRY | 38 | 0 |
| 418 | TCT | GAGCTTTGAGTTTTCTTTCT | 21729 | SpyCas9-SpRY | 38 | 0 |
| 419 | AGAAATC | ACTCGGAAGGCCAGGCCACCCA | 21730 | CdiCas9 | 38 | 0 |
| 420 | AGAA | TCGGAAGGCCAGGCCACCCA | 21731 | SpyCas9-3var-NRRH | 38 | 0 |
| 421 | AGAA | TCGGAAGGCCAGGCCACCCA | 21732 | SpyCas9-VQR | 38 | 0 |
| 422 | AAGAA | agACTCGGAAGGCCAGGCCACCC | 21733 | SauCas9 | 39 | 0 |
| 423 | AAGAA | ACTCGGAAGGCCAGGCCACCC | 21734 | SauCas9KKH | 39 | 0 |
| 424 | AAG | CTCGGAAGGCCAGGCCACCC | 21735 | ScaCas9 | 39 | 0 |
| 425 | AAG | CTCGGAAGGCCAGGCCACCC | 21736 | ScaCas9-HiFi-Sc++ | 39 | 0 |
| 426 | AAG | CTCGGAAGGCCAGGCCACCC | 21737 | ScaCas9-Sc++ | 39 | 0 |
| 427 | AAG | CTCGGAAGGCCAGGCCACCC | 21738 | SpyCas9-SpRY | 39 | 0 |
| 428 | TTC | TGAGCTTTGAGTTTTCTTTC | 21739 | SpyCas9-SpRY | 39 | 0 |
| 429 | AAGAAA | CTCGGAAGGCCAGGCCACCC | 21740 | St1Cas9-TH1477 | 39 | 0 |
| 430 | AAGAAA | ACTCGGAAGGCCAGGCCACCC | 21741 | cCas9-v17 | 39 | 0 |
| 431 | AAGAAA | ACTCGGAAGGCCAGGCCACCC | 21742 | cCas9-v42 | 39 | 0 |
| 432 | AAGAAAT | GACTCGGAAGGCCAGGCCACCC | 21743 | CdiCas9 | 39 | 0 |
| 433 | AAGAAAT | GACTCGGAAGGCCAGGCCACCC | 21744 | CdiCas9 | 39 | 0 |
| 434 | AAGA | CTCGGAAGGCCAGGCCACCC | 21745 | SpyCas9-3var-NRRH | 39 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 435 | CAAGA | GACTCGGAAGGCCAGGCCACC | 21746 | SauCas9KKH | 40 | 0 |
| 436 | CAAG | GACTCGGAAGGCCAGGCCACC | 21747 | SauriCas9-KKH | 40 | 0 |
| 437 | CAAG | ACTCGGAAGGCCAGGCCACC | 21748 | SpyCas9-QQR1 | 40 | 0 |
| 438 | CAAG | gaCTCGGAAGGCCAGGCCACC | 21749 | iSpyMacCas9 | 40 | 0 |
| 439 | CAA | ACTCGGAAGGCCAGGCCACC | 21750 | SpyCas9-SpRY | 40 | 0 |
| 440 | CTT | ATGAGCTTTGAGTTTTCTTT | 21751 | SpyCas9-SpRY | 40 | 0 |
| 441 | CAAGAAA | ACTCGGAAGGCCAGGCCACC | 21752 | St1Cas9 | 40 | 0 |
| 442 | CAAGAA | GACTCGGAAGGCCAGGCCACC | 21753 | cCas9-v17 | 40 | 0 |
| 443 | CAAGAA | GACTCGGAAGGCCAGGCCACC | 21754 | cCas9-v42 | 40 | 0 |
| 444 | CCAAG | AGACTCGGAAGGCCAGGCCAC | 21755 | SauCas9KKH | 41 | 0 |
| 445 | CCA | GACTCGGAAGGCCAGGCCAC | 21756 | SpyCas9-SpRY | 41 | 0 |
| 446 | TCT | GATGAGCTTTGAGTTTTCTT | 21757 | SpyCas9-SpRY | 41 | 0 |
| 447 | TCTTCTTT | ggtgATGAGCTTTGAGTTTTCTT | 21758 | BlatCas9 | 41 | 0 |
| 448 | TCTTC | ggtgATGAGCTTTGAGTTTTCTT | 21759 | BlatCas9 | 41 | 0 |
| 449 | CCAAGA | AGACTCGGAAGGCCAGGCCAC | 21760 | cCas9-v17 | 41 | 0 |
| 450 | CCAAGA | AGACTCGGAAGGCCAGGCCAC | 21761 | cCas9-v42 | 41 | 0 |
| 451 | CCCAA | AAGACTCGGAAGGCCAGGCCA | 21762 | SauCas9KKH | 42 | 0 |
| 452 | CCC | AGACTCGGAAGGCCAGGCCA | 21763 | SpyCas9-SpRY | 42 | 0 |
| 453 | TTC | TGATGAGCTTTGAGTTTTCT | 21764 | SpyCas9-SpRY | 42 | 0 |
| 454 | CCCAAG | AAGACTCGGAAGGCCAGGCCA | 21765 | cCas9-v17 | 42 | 0 |
| 455 | CCCAAG | AAGACTCGGAAGGCCAGGCCA | 21766 | cCas9-v42 | 42 | 0 |
| 456 | ACC | AAGACTCGGAAGGCCAGGCC | 21767 | SpyCas9-SpRY | 43 | 0 |
| 457 | TTT | GTGATGAGCTTTGAGTTTTC | 21768 | SpyCas9-SpRY | 43 | 0 |
| 458 | CAC | GAAGACTCGGAAGGCCAGGC | 21769 | SpyCas9-SpRY | 44 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 459 | CTT | GGTGATGAGCTTTGAGTTTT | 21770 | SpyCas9-SpRY | 44 | 0 |
| 460 | CACCCAAG | gtggAAGACTCGGAAGGCCAGGC | 21771 | BlatCas9 | 44 | 0 |
| 461 | CACCC | gtggAAGACTCGGAAGGCCAGGC | 21772 | BlatCas9 | 44 | 0 |
| 462 | CTTTC | agtgGTGATGAGCTTTGAGTTTT | 21773 | BlatCas9 | 44 | 0 |
| 463 | CACC | GAAGACTCGGAAGGCCAGGC | 21774 | SpyCas9-3var-NRCH | 44 | 0 |
| 464 | CCACCC | caGTGGAAGACTCGGAAGGCCAGG | 21775 | Nme2Cas9 | 45 | 0 |
| 465 | CCA | GGAAGACTCGGAAGGCCAGG | 21776 | SpyCas9-SpRY | 45 | 0 |
| 466 | TCT | TGGTGATGAGCTTTGAGTTT | 21777 | SpyCas9-SpRY | 45 | 0 |
| 467 | CCACCCAA | agtgGAAGACTCGGAAGGCCAGG | 21778 | BlatCas9 | 45 | 0 |
| 468 | CCACCCA A | agtgGAAGACTCGGAAGGCCAGG | 21779 | BlatCas9 | 45 | 0 |
| 469 | CCACC | agtgGAAGACTCGGAAGGCCAGG | 21780 | BlatCas9 | 45 | 0 |
| 470 | GCCACC | gcAGTGGAAGACTCGGAAGGCCAG | 21781 | Nme2Cas9 | 46 | 0 |
| 471 | GCC | TGGAAGACTCGGAAGGCCAG | 21782 | SpyCas9-SpRY | 46 | 0 |
| 472 | TTC | GTGGTGATGAGCTTTGAGTT | 21783 | SpyCas9-SpRY | 46 | 0 |
| 473 | GCCAC | cagtGGAAGACTCGGAAGGCCAG | 21784 | BlatCas9 | 46 | 0 |
| 474 | GG | GTGGAAGACTCGGAAGGCCA | 21785 | SpyCas9-NG | 47 | 0 |
| 475 | GG | GTGGAAGACTCGGAAGGCCA | 21786 | SpyCas9-xCas | 47 | 0 |
| 476 | GG | GTGGAAGACTCGGAAGGCCA | 21787 | SpyCas9-xCas-NG | 47 | 0 |
| 477 | GGC | GTGGAAGACTCGGAAGGCCA | 21788 | SpyCas9-SpG | 47 | 0 |
| 478 | GGC | GTGGAAGACTCGGAAGGCCA | 21789 | SpyCas9-SpRY | 47 | 0 |
| 479 | TTT | AGTGGTGATGAGCTTTGAGT | 21790 | SpyCas9-SpRY | 47 | 0 |
| 480 | GGCC | GTGGAAGACTCGGAAGGCCA | 21791 | SpyCas9-3var-NRCH | 47 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 481 | AGG | AGTGGAAGACTCGGAAGGCC | 21792 | ScaCas9 | 48 | 0 |
| 482 | AGG | AGTGGAAGACTCGGAAGGCC | 21793 | ScaCas9-HiFi-Sc++ | 48 | 0 |
| 483 | AGG | AGTGGAAGACTCGGAAGGCC | 21794 | ScaCas9-Sc++ | 48 | 0 |
| 484 | AGG | AGTGGAAGACTCGGAAGGCC | 21795 | SpyCas9 | 48 | 0 |
| 485 | AGG | AGTGGAAGACTCGGAAGGCC | 21796 | SpyCas9-HF1 | 48 | 0 |
| 486 | AGG | AGTGGAAGACTCGGAAGGCC | 21797 | SpyCas9-SpG | 48 | 0 |
| 487 | AGG | AGTGGAAGACTCGGAAGGCC | 21798 | SpyCas9-SpRY | 48 | 0 |
| 488 | AG | AGTGGAAGACTCGGAAGGCC | 21799 | SpyCas9-NG | 48 | 0 |
| 489 | AG | AGTGGAAGACTCGGAAGGCC | 21800 | SpyCas9-xCas | 48 | 0 |
| 490 | AG | AGTGGAAGACTCGGAAGGCC | 21801 | SpyCas9-xCas-NG | 48 | 0 |
| 491 | TTT | CAGTGGTGATGAGCTTTGAG | 21802 | SpyCas9-SpRY | 48 | 0 |
| 492 | TTTTCTTT | actcAGTGGTGATGAGCTTTGAG | 21803 | BlatCas9 | 48 | 0 |
| 493 | AGGCC | tgcaGTGGAAGACTCGGAAGGCC | 21804 | BlatCas9 | 48 | 0 |
| 494 | TTTTC | actcAGTGGTGATGAGCTTTGAG | 21805 | BlatCas9 | 48 | 0 |
| 495 | AGGCCAC | GCAGTGGAAGACTCGGAAGGCC | 21806 | CdiCas9 | 48 | 0 |
| 496 | AGGC | AGTGGAAGACTCGGAAGGCC | 21807 | SpyCas9-3var-NRRH | 48 | 0 |
| 497 | CAGGCC | tgTGCAGTGGAAGACTCGGAAGGC | 21808 | Nme2Cas9 | 49 | 0 |
| 498 | CAGG | GCAGTGGAAGACTCGGAAGGC | 21809 | SauriCas9 | 49 | 0 |
| 499 | CAGG | GCAGTGGAAGACTCGGAAGGC | 21810 | SauriCas9-KKH | 49 | 0 |
| 500 | CAG | CAGTGGAAGACTCGGAAGGC | 21811 | ScaCas9 | 49 | 0 |
| 501 | CAG | CAGTGGAAGACTCGGAAGGC | 21812 | ScaCas9-HiFi-Sc++ | 49 | 0 |
| 502 | CAG | CAGTGGAAGACTCGGAAGGC | 21813 | ScaCas9-Sc++ | 49 | 0 |
| 503 | CAG | CAGTGGAAGACTCGGAAGGC | 21814 | SpyCas9-SpRY | 49 | 0 |
| 504 | GTT | TCAGTGGTGATGAGCTTTGA | 21815 | SpyCas9-SpRY | 49 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 505 | CAGGC | gtgcAGTGGAAGACTCGGAAGGC | 21816 | BlatCas9 | 49 | 0 |
| 506 | CCAGG | TGCAGTGGAAGACTCGGAAGG | 21817 | SauCas9KKH | 50 | 0 |
| 507 | CCAG | TGCAGTGGAAGACTCGGAAGG | 21818 | SauriCas9-KKH | 50 | 0 |
| 508 | AG | CTCAGTGGTGATGAGCTTTG | 21819 | SpyCas9-NG | 50 | 0 |
| 509 | AG | CTCAGTGGTGATGAGCTTTG | 21820 | SpyCas9-xCas | 50 | 0 |
| 510 | AG | CTCAGTGGTGATGAGCTTTG | 21821 | SpyCas9-xCas-NG | 50 | 0 |
| 511 | AGT | CTCAGTGGTGATGAGCTTTG | 21822 | SpyCas9-SpG | 50 | 0 |
| 512 | AGT | CTCAGTGGTGATGAGCTTTG | 21823 | SpyCas9-SpRY | 50 | 0 |
| 513 | CCA | GCAGTGGAAGACTCGGAAGG | 21824 | SpyCas9-SpRY | 50 | 0 |
| 514 | CCAGGC | TGCAGTGGAAGACTCGGAAGG | 21825 | cCas9-v17 | 50 | 0 |
| 515 | CCAGGC | TGCAGTGGAAGACTCGGAAGG | 21826 | cCas9-v42 | 50 | 0 |
| 516 | AGTT | CTCAGTGGTGATGAGCTTTG | 21827 | SpyCas9-3var-NRTH | 50 | 0 |
| 517 | GCCAG | GTGCAGTGGAAGACTCGGAAG | 21828 | SauCas9KKH | 51 | 0 |
| 518 | GAG | ACTCAGTGGTGATGAGCTTT | 21829 | ScaCas9 | 51 | 0 |
| 519 | GAG | ACTCAGTGGTGATGAGCTTT | 21830 | ScaCas9-HiFi-Sc++ | 51 | 0 |
| 520 | GAG | ACTCAGTGGTGATGAGCTTT | 21831 | ScaCas9-Sc++ | 51 | 0 |
| 521 | GAG | ACTCAGTGGTGATGAGCTTT | 21832 | SpyCas9-SpRY | 51 | 0 |
| 522 | GCC | TGCAGTGGAAGACTCGGAAG | 21833 | SpyCas9-SpRY | 51 | 0 |
| 523 | GCCAGG | GTGCAGTGGAAGACTCGGAAG | 21834 | cCas9-v17 | 51 | 0 |
| 524 | GCCAGG | GTGCAGTGGAAGACTCGGAAG | 21835 | cCas9-v42 | 51 | 0 |
| 525 | GAGTTTT | TGACTCAGTGGTGATGAGCTTT | 21836 | CdiCas9 | 51 | 0 |
| 526 | GAGT | ACTCAGTGGTGATGAGCTTT | 21837 | SpyCas9-3var-NRRH | 51 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 527 | TGAG | TGACTCAGTGGTGATGAGCTT | 21838 | SauriCas9-KKH | 52 | 0 |
| 528 | TGAG | GACTCAGTGGTGATGAGCTT | 21839 | SpyCas9-VQR | 52 | 0 |
| 529 | GG | GTGCAGTGGAAGACTCGGAA | 21840 | SpyCas9-NG | 52 | 0 |
| 530 | GG | GTGCAGTGGAAGACTCGGAA | 21841 | SpyCas9-xCas | 52 | 0 |
| 531 | GG | GTGCAGTGGAAGACTCGGAA | 21842 | SpyCas9-xCas-NG | 52 | 0 |
| 532 | TG | GACTCAGTGGTGATGAGCTT | 21843 | SpyCas9-NG | 52 | 0 |
| 533 | TG | GACTCAGTGGTGATGAGCTT | 21844 | SpyCas9-xCas | 52 | 0 |
| 534 | TG | GACTCAGTGGTGATGAGCTT | 21845 | SpyCas9-xCas-NG | 52 | 0 |
| 535 | GGC | GTGCAGTGGAAGACTCGGAA | 21846 | SpyCas9-SpG | 52 | 0 |
| 536 | GGC | GTGCAGTGGAAGACTCGGAA | 21847 | SpyCas9-SpRY | 52 | 0 |
| 537 | TGA | GACTCAGTGGTGATGAGCTT | 21848 | SpyCas9-SpG | 52 | 0 |
| 538 | TGA | GACTCAGTGGTGATGAGCTT | 21849 | SpyCas9-SpRY | 52 | 0 |
| 539 | TGAGTT | TGACTCAGTGGTGATGAGCTT | 21850 | cCas9-v16 | 52 | 0 |
| 540 | TGAGTT | TGACTCAGTGGTGATGAGCTT | 21851 | cCas9-v21 | 52 | 0 |
| 541 | GGCC | GTGCAGTGGAAGACTCGGAA | 21852 | SpyCas9-3var-NRCH | 52 | 0 |
| 542 | TTGAGTT | cctCTGACTCAGTGGTGATGAGCT | 21853 | PpnCas9 | 53 | 0 |
| 543 | TTGAG | ctCTGACTCAGTGGTGATGAGCT | 21854 | SauCas9 | 53 | 0 |
| 544 | TTGAG | CTGACTCAGTGGTGATGAGCT | 21855 | SauCas9KKH | 53 | 0 |
| 545 | TTGAGT | ctCTGACTCAGTGGTGATGAGCT | 21856 | SauCas9 | 53 | 0 |
| 546 | TTGAGT | CTGACTCAGTGGTGATGAGCT | 21857 | SauCas9KKH | 53 | 0 |
| 547 | TTGAGT | CTGACTCAGTGGTGATGAGCT | 21858 | cCas9-v17 | 53 | 0 |
| 548 | TTGAGT | CTGACTCAGTGGTGATGAGCT | 21859 | cCas9-v42 | 53 | 0 |
| 549 | AGG | TGTGCAGTGGAAGACTCGGA | 21860 | ScaCas9 | 53 | 0 |
| 550 | AGG | TGTGCAGTGGAAGACTCGGA | 21861 | ScaCas9-HiFi-Sc++ | 53 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 551 | AGG | TGTGCAGTGGAAGACTCGGA | 21862 | ScaCas9-Sc++ | 53 | 0 |
| 552 | AGG | TGTGCAGTGGAAGACTCGGA | 21863 | SpyCas9 | 53 | 0 |
| 553 | AGG | TGTGCAGTGGAAGACTCGGA | 21864 | SpyCas9-HF1 | 53 | 0 |
| 554 | AGG | TGTGCAGTGGAAGACTCGGA | 21865 | SpyCas9-SpG | 53 | 0 |
| 555 | AGG | TGTGCAGTGGAAGACTCGGA | 21866 | SpyCas9-SpRY | 53 | 0 |
| 556 | TTG | TGACTCAGTGGTGATGAGCT | 21867 | ScaCas9 | 53 | 0 |
| 557 | TTG | TGACTCAGTGGTGATGAGCT | 21868 | ScaCas9-HiFi-Sc++ | 53 | 0 |
| 558 | TTG | TGACTCAGTGGTGATGAGCT | 21869 | ScaCas9-Sc++ | 53 | 0 |
| 559 | TTG | TGACTCAGTGGTGATGAGCT | 21870 | SpyCas9-SpRY | 53 | 0 |
| 560 | AG | TGTGCAGTGGAAGACTCGGA | 21871 | SpyCas9-NG | 53 | 0 |
| 561 | AG | TGTGCAGTGGAAGACTCGGA | 21872 | SpyCas9-xCas | 53 | 0 |
| 562 | AG | TGTGCAGTGGAAGACTCGGA | 21873 | SpyCas9-xCas-NG | 53 | 0 |
| 563 | AGGCCAGG | ctgtGTGCAGTGGAAGACTCGGA | 21874 | BlatCas9 | 53 | 0 |
| 564 | AGGCC | ctgtGTGCAGTGGAAGACTCGGA | 21875 | BlatCas9 | 53 | 0 |
| 565 | TTGAGTTT | cctcTGACTCAGTGGTGATGAGCT | 21876 | NmeCas9 | 53 | 0 |
| 566 | AGGC | TGTGCAGTGGAAGACTCGGA | 21877 | SpyCas9-3var-NRRH | 53 | 0 |
| 567 | AAGGCC | taCTGTGTGCAGTGGAAGACTCGG | 21878 | Nme2Cas9 | 54 | 0 |
| 568 | TTTGA | TCTGACTCAGTGGTGATGAGC | 21879 | SauCas9KKH | 54 | 0 |
| 569 | AAGG | TGTGTGCAGTGGAAGACTCGG | 21880 | SauriCas9 | 54 | 0 |
| 570 | AAGG | TGTGTGCAGTGGAAGACTCGG | 21881 | SauriCas9-KKH | 54 | 0 |
| 571 | AAG | GTGTGCAGTGGAAGACTCGG | 21882 | ScaCas9 | 54 | 0 |
| 572 | AAG | GTGTGCAGTGGAAGACTCGG | 21883 | ScaCas9-HiFi-Sc++ | 54 | 0 |
| 573 | AAG | GTGTGCAGTGGAAGACTCGG | 21884 | ScaCas9-Sc++ | 54 | 0 |
| 574 | AAG | GTGTGCAGTGGAAGACTCGG | 21885 | SpyCas9-SpRY | 54 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 575 | TTT | CTGACTCAGTGGTGATGAGC | 21886 | SpyCas9-SpRY | 54 | 0 |
| 576 | AAGGCCAG | actgTGTGCAGTGGAAGACTCGG | 21887 | BlatCas9 | 54 | 0 |
| 577 | AAGGC | actgTGTGCAGTGGAAGACTCGG | 21888 | BlatCas9 | 54 | 0 |
| 578 | GAAGG | CTGTGTGCAGTGGAAGACTCG | 21889 | SauCas9KKH | 55 | 0 |
| 579 | GAAG | CTGTGTGCAGTGGAAGACTCG | 21890 | SauriCas9-KKH | 55 | 0 |
| 580 | GAAG | TGTGTGCAGTGGAAGACTCG | 21891 | SpyCas9-QQR1 | 55 | 0 |
| 581 | GAAG | ctGTGTGCAGTGGAAGACTCG | 21892 | iSpyMacCas9 | 55 | 0 |
| 582 | GAA | TGTGTGCAGTGGAAGACTCG | 21893 | SpyCas9-SpRY | 55 | 0 |
| 583 | GAA | TGTGTGCAGTGGAAGACTCG | 21894 | SpyCas9-xCas | 55 | 0 |
| 584 | CTT | TCTGACTCAGTGGTGATGAG | 21895 | SpyCas9-SpRY | 55 | 0 |
| 585 | GAAGGC | CTGTGTGCAGTGGAAGACTCG | 21896 | cCas9-v17 | 55 | 0 |
| 586 | GAAGGC | CTGTGTGCAGTGGAAGACTCG | 21897 | cCas9-v42 | 55 | 0 |
| 587 | GGAAG | ACTGTGTGCAGTGGAAGACTC | 21898 | SauCas9KKH | 56 | 0 |
| 588 | GG | CTGTGTGCAGTGGAAGACTC | 21899 | SpyCas9-NG | 56 | 0 |
| 589 | GG | CTGTGTGCAGTGGAAGACTC | 21900 | SpyCas9-xCas | 56 | 0 |
| 590 | GG | CTGTGTGCAGTGGAAGACTC | 21901 | SpyCas9-xCas-NG | 56 | 0 |
| 591 | GGA | CTGTGTGCAGTGGAAGACTC | 21902 | SpyCas9-SpG | 56 | 0 |
| 592 | GGA | CTGTGTGCAGTGGAAGACTC | 21903 | SpyCas9-SpRY | 56 | 0 |
| 593 | GCT | CTCTGACTCAGTGGTGATGA | 21904 | SpyCas9-SpRY | 56 | 0 |
| 594 | GGAAGG | ACTGTGTGCAGTGGAAGACTC | 21905 | cCas9-v17 | 56 | 0 |
| 595 | GGAAGG | ACTGTGTGCAGTGGAAGACTC | 21906 | cCas9-v42 | 56 | 0 |
| 596 | GGAA | CTGTGTGCAGTGGAAGACTC | 21907 | SpyCas9-3var-NRRH | 56 | 0 |
| 597 | GGAA | CTGTGTGCAGTGGAAGACTC | 21908 | SpyCas9-VQR | 56 | 0 |
| 598 | CGGAA | tgTACTGTGTGCAGTGGAAGACT | 21909 | SauCas9 | 57 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 599 | CGGAA | TACTGTGTGCAGTGGAAGACT | 21910 | SauCas9KKH | 57 | 0 |
| 600 | CGG | ACTGTGTGCAGTGGAAGACT | 21911 | ScaCas9 | 57 | 0 |
| 601 | CGG | ACTGTGTGCAGTGGAAGACT | 21912 | ScaCas9-HiFi-Sc++ | 57 | 0 |
| 602 | CGG | ACTGTGTGCAGTGGAAGACT | 21913 | ScaCas9-Sc++ | 57 | 0 |
| 603 | CGG | ACTGTGTGCAGTGGAAGACT | 21914 | SpyCas9 | 57 | 0 |
| 604 | CGG | ACTGTGTGCAGTGGAAGACT | 21915 | SpyCas9-HF1 | 57 | 0 |
| 605 | CGG | ACTGTGTGCAGTGGAAGACT | 21916 | SpyCas9-SpG | 57 | 0 |
| 606 | CGG | ACTGTGTGCAGTGGAAGACT | 21917 | SpyCas9-SpRY | 57 | 0 |
| 607 | CG | ACTGTGTGCAGTGGAAGACT | 21918 | SpyCas9-NG | 57 | 0 |
| 608 | CG | ACTGTGTGCAGTGGAAGACT | 21919 | SpyCas9-xCas | 57 | 0 |
| 609 | CG | ACTGTGTGCAGTGGAAGACT | 21920 | SpyCas9-xCas-NG | 57 | 0 |
| 610 | AG | CCTCTGACTCAGTGGTGATG | 21921 | SpyCas9-NG | 57 | 0 |
| 611 | AG | CCTCTGACTCAGTGGTGATG | 21922 | SpyCas9-xCas | 57 | 0 |
| 612 | AG | CCTCTGACTCAGTGGTGATG | 21923 | SpyCas9-xCas-NG | 57 | 0 |
| 613 | AGC | CCTCTGACTCAGTGGTGATG | 21924 | SpyCas9-SpG | 57 | 0 |
| 614 | AGC | CCTCTGACTCAGTGGTGATG | 21925 | SpyCas9-SpRY | 57 | 0 |
| 615 | CGGAAG | TACTGTGTGCAGTGGAAGACT | 21926 | cCas9-v17 | 57 | 0 |
| 616 | CGGAAG | TACTGTGTGCAGTGGAAGACT | 21927 | cCas9-v42 | 57 | 0 |
| 617 | CGGA | ACTGTGTGCAGTGGAAGACT | 21928 | SpyCas9-3var-NRRH | 57 | 0 |
| 618 | AGCT | CCTCTGACTCAGTGGTGATG | 21929 | SpyCas9-3var-NRCH | 57 | 0 |
| 619 | TCGGA | atGTACTGTGTGCAGTGGAAGAC | 21930 | SauCas9 | 58 | 0 |
| 620 | TCGGA | GTACTGTGTGCAGTGGAAGAC | 21931 | SauCas9KKH | 58 | 0 |
| 621 | TCGG | GTACTGTGTGCAGTGGAAGAC | 21932 | SauriCas9 | 58 | 0 |
| 622 | TCGG | GTACTGTGTGCAGTGGAAGAC | 21933 | SauriCas9-KKH | 58 | 0 |
| 623 | TCG | TACTGTGTGCAGTGGAAGAC | 21934 | ScaCas9 | 58 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 624 | TCG | TACTGTGTGCAGTGGAAGAC | 21935 | ScaCas9-HiFi-Sc++ | 58 | 0 |
| 625 | TCG | TACTGTGTGCAGTGGAAGAC | 21936 | ScaCas9-Sc++ | 58 | 0 |
| 626 | TCG | TACTGTGTGCAGTGGAAGAC | 21937 | SpyCas9-SpRY | 58 | 0 |
| 627 | GAG | GCCTCTGACTCAGTGGTGAT | 21938 | ScaCas9 | 58 | 0 |
| 628 | GAG | GCCTCTGACTCAGTGGTGAT | 21939 | ScaCas9-HiFi-Sc++ | 58 | 0 |
| 629 | GAG | GCCTCTGACTCAGTGGTGAT | 21940 | ScaCas9-Sc++ | 58 | 0 |
| 630 | GAG | GCCTCTGACTCAGTGGTGAT | 21941 | SpyCas9-SpRY | 58 | 0 |
| 631 | TCGGAA | GTACTGTGTGCAGTGGAAGAC | 21942 | cCas9-v17 | 58 | 0 |
| 632 | TCGGAA | GTACTGTGTGCAGTGGAAGAC | 21943 | cCas9-v42 | 58 | 0 |
| 633 | GAGCTTT | GTGCCTCTGACTCAGTGGTGAT | 21944 | CdiCas9 | 58 | 0 |
| 634 | GAGC | GCCTCTGACTCAGTGGTGAT | 21945 | SpyCas9-3var-NRRH | 58 | 0 |
| 635 | CTCGG | TGTACTGTGTGCAGTGGAAGA | 21946 | SauCas9KKH | 59 | 0 |
| 636 | TGAG | GTGCCTCTGACTCAGTGGTGA | 21947 | SauriCas9-KKH | 59 | 0 |
| 637 | TGAG | TGCCTCTGACTCAGTGGTGA | 21948 | SpyCas9-VQR | 59 | 0 |
| 638 | TG | TGCCTCTGACTCAGTGGTGA | 21949 | SpyCas9-NG | 59 | 0 |
| 639 | TG | TGCCTCTGACTCAGTGGTGA | 21950 | SpyCas9-xCas | 59 | 0 |
| 640 | TG | TGCCTCTGACTCAGTGGTGA | 21951 | SpyCas9-xCas-NG | 59 | 0 |
| 641 | TGA | TGCCTCTGACTCAGTGGTGA | 21952 | SpyCas9-SpG | 59 | 0 |
| 642 | TGA | TGCCTCTGACTCAGTGGTGA | 21953 | SpyCas9-SpRY | 59 | 0 |
| 643 | CTC | GTACTGTGTGCAGTGGAAGA | 21954 | SpyCas9-SpRY | 59 | 0 |
| 644 | TGAGCTTT | tagtGCCTCTGACTCAGTGGTGA | 21955 | BlatCas9 | 59 | 0 |
| 645 | TGAGC | tagtGCCTCTGACTCAGTGGTGA | 21956 | BlatCas9 | 59 | 0 |
| 646 | TGAGCT | GTGCCTCTGACTCAGTGGTGA | 21957 | cCas9-v16 | 59 | 0 |
| 647 | TGAGCT | GTGCCTCTGACTCAGTGGTGA | 21958 | cCas9-v21 | 59 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 648 | CTCGGA | TGTACTGTGTGCAGTGGAAGA | 21959 | cCas9-v17 | 59 | 0 |
| 649 | CTCGGA | TGTACTGTGTGCAGTGGAAGA | 21960 | cCas9-v42 | 59 | 0 |
| 650 | ATGAG | ctAGTGCCTCTGACTCAGTGGTG | 21961 | SauCas9 | 60 | 0 |
| 651 | ATGAG | AGTGCCTCTGACTCAGTGGTG | 21962 | SauCas9KKH | 60 | 0 |
| 652 | ATG | GTGCCTCTGACTCAGTGGTG | 21963 | ScaCas9 | 60 | 0 |
| 653 | ATG | GTGCCTCTGACTCAGTGGTG | 21964 | ScaCas9-HiFi-Sc++ | 60 | 0 |
| 654 | ATG | GTGCCTCTGACTCAGTGGTG | 21965 | ScaCas9-Sc++ | 60 | 0 |
| 655 | ATG | GTGCCTCTGACTCAGTGGTG | 21966 | SpyCas9-SpRY | 60 | 0 |
| 656 | ACT | TGTACTGTGTGCAGTGGAAG | 21967 | SpyCas9-SpRY | 60 | 0 |
| 657 | ATGAGC | AGTGCCTCTGACTCAGTGGTG | 21968 | cCas9-v17 | 60 | 0 |
| 658 | ATGAGC | AGTGCCTCTGACTCAGTGGTG | 21969 | cCas9-v42 | 60 | 0 |
| 659 | ATGAGCTT | cctaGTGCCTCTGACTCAGTGGTG | 21970 | NmeCas9 | 60 | 0 |
| 660 | GATGA | TAGTGCCTCTGACTCAGTGGT | 21971 | SauCas9KKH | 61 | 0 |
| 661 | GAC | ATGTACTGTGTGCAGTGGAA | 21972 | SpyCas9-SpRY | 61 | 0 |
| 662 | GAT | AGTGCCTCTGACTCAGTGGT | 21973 | SpyCas9-SpRY | 61 | 0 |
| 663 | GAT | AGTGCCTCTGACTCAGTGGT | 21974 | SpyCas9-xCas | 61 | 0 |
| 664 | GACTCGGA | ctgaTGTACTGTGTGCAGTGGAA | 21975 | BlatCas9 | 61 | 0 |
| 665 | GACTC | ctgaTGTACTGTGTGCAGTGGAA | 21976 | BlatCas9 | 61 | 0 |
| 666 | GACT | ATGTACTGTGTGCAGTGGAA | 21977 | SpyCas9-3var-NRCH | 61 | 0 |
| 667 | AG | GATGTACTGTGTGCAGTGGA | 21978 | SpyCas9-NG | 62 | 0 |
| 668 | AG | GATGTACTGTGTGCAGTGGA | 21979 | SpyCas9-xCas | 62 | 0 |
| 669 | AG | GATGTACTGTGTGCAGTGGA | 21980 | SpyCas9-xCas-NG | 62 | 0 |
| 670 | TG | TAGTGCCTCTGACTCAGTGG | 21981 | SpyCas9-NG | 62 | 0 |
| 671 | TG | TAGTGCCTCTGACTCAGTGG | 21982 | SpyCas9-xCas | 62 | 0 |
| 672 | TG | TAGTGCCTCTGACTCAGTGG | 21983 | SpyCas9-xCas-NG | 62 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 673 | AGA | GATGTACTGTGTGCAGTGGA | 21984 | SpyCas9-SpG | 62 | 0 |
| 674 | AGA | GATGTACTGTGTGCAGTGGA | 21985 | SpyCas9-SpRY | 62 | 0 |
| 675 | TGA | TAGTGCCTCTGACTCAGTGG | 21986 | SpyCas9-SpG | 62 | 0 |
| 676 | TGA | TAGTGCCTCTGACTCAGTGG | 21987 | SpyCas9-SpRY | 62 | 0 |
| 677 | AGAC | GATGTACTGTGTGCAGTGGA | 21988 | SpyCas9-3var-NRRH | 62 | 0 |
| 678 | AGAC | GATGTACTGTGTGCAGTGGA | 21989 | SpyCas9-VQR | 62 | 0 |
| 679 | TGAT | TAGTGCCTCTGACTCAGTGG | 21990 | SpyCas9-3var-NRRH | 62 | 0 |
| 680 | TGAT | TAGTGCCTCTGACTCAGTGG | 21991 | SpyCas9-VQR | 62 | 0 |
| 681 | AAG | TGATGTACTGTGTGCAGTGG | 21992 | ScaCas9 | 63 | 0 |
| 682 | AAG | TGATGTACTGTGTGCAGTGG | 21993 | ScaCas9-HiFi-Sc++ | 63 | 0 |
| 683 | AAG | TGATGTACTGTGTGCAGTGG | 21994 | ScaCas9-Sc++ | 63 | 0 |
| 684 | AAG | TGATGTACTGTGTGCAGTGG | 21995 | SpyCas9-SpRY | 63 | 0 |
| 685 | GTG | CTAGTGCCTCTGACTCAGTG | 21996 | ScaCas9 | 63 | 0 |
| 686 | GTG | CTAGTGCCTCTGACTCAGTG | 21997 | ScaCas9-HiFi-Sc++ | 63 | 0 |
| 687 | GTG | CTAGTGCCTCTGACTCAGTG | 21998 | ScaCas9-Sc++ | 63 | 0 |
| 688 | GTG | CTAGTGCCTCTGACTCAGTG | 21999 | SpyCas9-SpRY | 63 | 0 |
| 689 | AAGAC | gtctGATGTACTGTGTGCAGTGG | 22000 | BlatCas9 | 63 | 0 |
| 690 | AAGACT | CTGATGTACTGTGTGCAGTGG | 22001 | cCas9-v16 | 63 | 0 |
| 691 | AAGACT | CTGATGTACTGTGTGCAGTGG | 22002 | cCas9-v21 | 63 | 0 |
| 692 | GTGATGA | CCTAGTGCCTCTGACTCAGTG | 22003 | cCas9-v16 | 63 | 0 |
| 693 | GTGATGA | CCTAGTGCCTCTGACTCAGTG | 22004 | cCas9-v21 | 63 | 0 |
| 694 | AAGACTC | TCTGATGTACTGTGTGCAGTGG | 22005 | CdiCas9 | 63 | 0 |
| 695 | AAGA | TGATGTACTGTGTGCAGTGG | 22006 | SpyCas9-3var-NRRH | 63 | 0 |
| 696 | GAAGA | TCTGATGTACTGTGTGCAGTG | 22007 | SauCas9KKH | 64 | 0 |
| 697 | GGTGA | TCCTAGTGCCTCTGACTCAGT | 22008 | SauCas9KKH | 64 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 698 | GGTGAT | TCCTAGTGCCTCTGACTCAGT | 22009 | SauCas9KKH | 64 | 0 |
| 699 | GAAG | TCTGATGTACTGTGTGCAGTG | 22010 | SauriCas9-KKH | 64 | 0 |
| 700 | GAAG | CTGATGTACTGTGTGCAGTG | 22011 | SpyCas9-QQR1 | 64 | 0 |
| 701 | GAAG | tcTGATGTACTGTGTGCAGTG | 22012 | iSpyMacCas9 | 64 | 0 |
| 702 | GG | CCTAGTGCCTCTGACTCAGT | 22013 | SpyCas9-NG | 64 | 0 |
| 703 | GG | CCTAGTGCCTCTGACTCAGT | 22014 | SpyCas9-xCas | 64 | 0 |
| 704 | GG | CCTAGTGCCTCTGACTCAGT | 22015 | SpyCas9-xCas-NG | 64 | 0 |
| 705 | GAA | CTGATGTACTGTGTGCAGTG | 22016 | SpyCas9-SpRY | 64 | 0 |
| 706 | GAA | CTGATGTACTGTGTGCAGTG | 22017 | SpyCas9-xCas | 64 | 0 |
| 707 | GGT | CCTAGTGCCTCTGACTCAGT | 22018 | SpyCas9-SpG | 64 | 0 |
| 708 | GGT | CCTAGTGCCTCTGACTCAGT | 22019 | SpyCas9-SpRY | 64 | 0 |
| 709 | GAAGAC | TCTGATGTACTGTGTGCAGTG | 22020 | cCas9-v17 | 64 | 0 |
| 710 | GAAGAC | TCTGATGTACTGTGTGCAGTG | 22021 | cCas9-v42 | 64 | 0 |
| 711 | GGAAG | GTCTGATGTACTGTGTGCAGT | 22022 | SauCas9KKH | 65 | 0 |
| 712 | TGG | TCCTAGTGCCTCTGACTCAG | 22023 | ScaCas9 | 65 | 0 |
| 713 | TGG | TCCTAGTGCCTCTGACTCAG | 22024 | ScaCas9-HiFi-Sc++ | 65 | 0 |
| 714 | TGG | TCCTAGTGCCTCTGACTCAG | 22025 | ScaCas9-Sc++ | 65 | 0 |
| 715 | TGG | TCCTAGTGCCTCTGACTCAG | 22026 | SpyCas9 | 65 | 0 |
| 716 | TGG | TCCTAGTGCCTCTGACTCAG | 22027 | SpyCas9-HF1 | 65 | 0 |
| 717 | TGG | TCCTAGTGCCTCTGACTCAG | 22028 | SpyCas9-SpG | 65 | 0 |
| 718 | TGG | TCCTAGTGCCTCTGACTCAG | 22029 | SpyCas9-SpRY | 65 | 0 |
| 719 | GG | TCTGATGTACTGTGTGCAGT | 22030 | SpyCas9-NG | 65 | 0 |
| 720 | GG | TCTGATGTACTGTGTGCAGT | 22031 | SpyCas9-xCas | 65 | 0 |
| 721 | GG | TCTGATGTACTGTGTGCAGT | 22032 | SpyCas9-xCas-NG | 65 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 722 | TG | TCCTAGTGCCTCTGACTCAG | 22033 | SpyCas9-NG | 65 | 0 |
| 723 | TG | TCCTAGTGCCTCTGACTCAG | 22034 | SpyCas9-xCas | 65 | 0 |
| 724 | TG | TCCTAGTGCCTCTGACTCAG | 22035 | SpyCas9-xCas-NG | 65 | 0 |
| 725 | GGA | TCTGATGTACTGTGTGCAGT | 22036 | SpyCas9-SpG | 65 | 0 |
| 726 | GGA | TCTGATGTACTGTGTGCAGT | 22037 | SpyCas9-SpRY | 65 | 0 |
| 727 | GGAAGA | GTCTGATGTACTGTGTGCAGT | 22038 | cCas9-v17 | 65 | 0 |
| 728 | GGAAGA | GTCTGATGTACTGTGTGCAGT | 22039 | cCas9-v42 | 65 | 0 |
| 729 | GGAAGACT | catgTCTGATGTACTGTGTGCAGT | 22040 | NmeCas9 | 65 | 0 |
| 730 | GGAA | TCTGATGTACTGTGTGCAGT | 22041 | SpyCas9-3var-NRRH | 65 | 0 |
| 731 | GGAA | TCTGATGTACTGTGTGCAGT | 22042 | SpyCas9-VQR | 65 | 0 |
| 732 | TGGT | TCCTAGTGCCTCTGACTCAG | 22043 | SpyCas9-3var-NRRH | 65 | 0 |
| 733 | TGGAA | caTGTCTGATGTACTGTGTGCAG | 22044 | SauCas9 | 66 | 0 |
| 734 | TGGAA | TGTCTGATGTACTGTGTGCAG | 22045 | SauCas9KKH | 66 | 0 |
| 735 | GTGG | TCTCCTAGTGCCTCTGACTCA | 22046 | SauriCas9 | 66 | 0 |
| 736 | GTGG | TCTCCTAGTGCCTCTGACTCA | 22047 | SauriCas9-KKH | 66 | 0 |
| 737 | TGG | GTCTGATGTACTGTGTGCAG | 22048 | ScaCas9 | 66 | 0 |
| 738 | TGG | GTCTGATGTACTGTGTGCAG | 22049 | ScaCas9-HiFi-Sc++ | 66 | 0 |
| 739 | TGG | GTCTGATGTACTGTGTGCAG | 22050 | ScaCas9-Sc++ | 66 | 0 |
| 740 | TGG | GTCTGATGTACTGTGTGCAG | 22051 | SpyCas9 | 66 | 0 |
| 741 | TGG | GTCTGATGTACTGTGTGCAG | 22052 | SpyCas9-HF1 | 66 | 0 |
| 742 | TGG | GTCTGATGTACTGTGTGCAG | 22053 | SpyCas9-SpG | 66 | 0 |
| 743 | TGG | GTCTGATGTACTGTGTGCAG | 22054 | SpyCas9-SpRY | 66 | 0 |
| 744 | GTG | CTCCTAGTGCCTCTGACTCA | 22055 | ScaCas9 | 66 | 0 |
| 745 | GTG | CTCCTAGTGCCTCTGACTCA | 22056 | ScaCas9-HiFi-Sc++ | 66 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 746 | GTG | CTCCTAGTGCCTCTGACTCA | 22057 | ScaCas9-Sc++ | 66 | 0 |
| 747 | GTG | CTCCTAGTGCCTCTGACTCA | 22058 | SpyCas9-SpRY | 66 | 0 |
| 748 | TG | GTCTGATGTACTGTGTGCAG | 22059 | SpyCas9-NG | 66 | 0 |
| 749 | TG | GTCTGATGTACTGTGTGCAG | 22060 | SpyCas9-xCas | 66 | 0 |
| 750 | TG | GTCTGATGTACTGTGTGCAG | 22061 | SpyCas9-xCas-NG | 66 | 0 |
| 751 | GTGGTG | TCTCCTAGTGCCTCTGACTCA | 22062 | cCas9-v16 | 66 | 0 |
| 752 | GTGGTG | TCTCCTAGTGCCTCTGACTCA | 22063 | cCas9-v21 | 66 | 0 |
| 753 | TGGAAG | TGTCTGATGTACTGTGTGCAG | 22064 | cCas9-v17 | 66 | 0 |
| 754 | TGGAAG | TGTCTGATGTACTGTGTGCAG | 22065 | cCas9-v42 | 66 | 0 |
| 755 | TGGA | GTCTGATGTACTGTGTGCAG | 22066 | SpyCas9-3var-NRRH | 66 | 0 |
| 756 | GTGGA | ccATGTCTGATGTACTGTGTGCA | 22067 | SauCas9 | 67 | 0 |
| 757 | GTGGA | ATGTCTGATGTACTGTGTGCA | 22068 | SauCas9KKH | 67 | 0 |
| 758 | AGTGG | GTCTCCTAGTGCCTCTGACTC | 22069 | SauCas9KKH | 67 | 0 |
| 759 | AGTGGT | GTCTCCTAGTGCCTCTGACTC | 22070 | SauCas9KKH | 67 | 0 |
| 760 | GTGG | ATGTCTGATGTACTGTGTGCA | 22071 | SauriCas9 | 67 | 0 |
| 761 | GTGG | ATGTCTGATGTACTGTGTGCA | 22072 | SauriCas9-KKH | 67 | 0 |
| 762 | GTG | TGTCTGATGTACTGTGTGCA | 22073 | ScaCas9 | 67 | 0 |
| 763 | GTG | TGTCTGATGTACTGTGTGCA | 22074 | ScaCas9-HiFi-Sc++ | 67 | 0 |
| 764 | GTG | TGTCTGATGTACTGTGTGCA | 22075 | ScaCas9-Sc++ | 67 | 0 |
| 765 | GTG | TGTCTGATGTACTGTGTGCA | 22076 | SpyCas9-SpRY | 67 | 0 |
| 766 | AG | TCTCCTAGTGCCTCTGACTC | 22077 | SpyCas9-NG | 67 | 0 |
| 767 | AG | TCTCCTAGTGCCTCTGACTC | 22078 | SpyCas9-xCas | 67 | 0 |
| 768 | AG | TCTCCTAGTGCCTCTGACTC | 22079 | SpyCas9-xCas-NG | 67 | 0 |
| 769 | AGT | TCTCCTAGTGCCTCTGACTC | 22080 | SpyCas9-SpG | 67 | 0 |
| 770 | AGT | TCTCCTAGTGCCTCTGACTC | 22081 | SpyCas9-SpRY | 67 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 771 | GTGGAA | ATGTCTGATGTACTGTGTGCA | 22082 | cCas9-v17 | 67 | 0 |
| 772 | GTGGAA | ATGTCTGATGTACTGTGTGCA | 22083 | cCas9-v42 | 67 | 0 |
| 773 | AGTGG | CATGTCTGATGTACTGTGTGC | 22084 | SauCas9KKH | 68 | 0 |
| 774 | CAG | GTCTCCTAGTGCCTCTGACT | 22085 | ScaCas9 | 68 | 0 |
| 775 | CAG | GTCTCCTAGTGCCTCTGACT | 22086 | ScaCas9-HiFi-Sc++ | 68 | 0 |
| 776 | CAG | GTCTCCTAGTGCCTCTGACT | 22087 | ScaCas9-Sc++ | 68 | 0 |
| 777 | CAG | GTCTCCTAGTGCCTCTGACT | 22088 | SpyCas9-SpRY | 68 | 0 |
| 778 | AG | ATGTCTGATGTACTGTGTGC | 22089 | SpyCas9-NG | 68 | 0 |
| 779 | AG | ATGTCTGATGTACTGTGTGC | 22090 | SpyCas9-xCas | 68 | 0 |
| 780 | AG | ATGTCTGATGTACTGTGTGC | 22091 | SpyCas9-xCas-NG | 68 | 0 |
| 781 | AGT | ATGTCTGATGTACTGTGTGC | 22092 | SpyCas9-SpG | 68 | 0 |
| 782 | AGT | ATGTCTGATGTACTGTGTGC | 22093 | SpyCas9-SpRY | 68 | 0 |
| 783 | CAGT | GTCTCCTAGTGCCTCTGACT | 22094 | SpyCas9-3var-NRRH | 68 | 0 |
| 784 | TCAG | AGGTCTCCTAGTGCCTCTGAC | 22095 | SauriCas9-KKH | 69 | 0 |
| 785 | CAG | CATGTCTGATGTACTGTGTG | 22096 | ScaCas9 | 69 | 0 |
| 786 | CAG | CATGTCTGATGTACTGTGTG | 22097 | ScaCas9-HiFi-Sc++ | 69 | 0 |
| 787 | CAG | CATGTCTGATGTACTGTGTG | 22098 | ScaCas9-Sc++ | 69 | 0 |
| 788 | CAG | CATGTCTGATGTACTGTGTG | 22099 | SpyCas9-SpRY | 69 | 0 |
| 789 | TCA | GGTCTCCTAGTGCCTCTGAC | 22100 | SpyCas9-SpRY | 69 | 0 |
| 790 | TCAGTG | AGGTCTCCTAGTGCCTCTGAC | 22101 | cCas9-v16 | 69 | 0 |
| 791 | TCAGTG | AGGTCTCCTAGTGCCTCTGAC | 22102 | cCas9-v21 | 69 | 0 |
| 792 | CAGT | CATGTCTGATGTACTGTGTG | 22103 | SpyCas9-3var-NRRH | 69 | 0 |
| 793 | CTCAG | AAGGTCTCCTAGTGCCTCTGA | 22104 | SauCas9KKH | 70 | 0 |
| 794 | CTCAGT | AAGGTCTCCTAGTGCCTCTGA | 22105 | SauCas9KKH | 70 | 0 |
| 795 | CTCAGT | AAGGTCTCCTAGTGCCTCTGA | 22106 | cCas9-v17 | 70 | 0 |
| 796 | CTCAGT | AAGGTCTCCTAGTGCCTCTGA | 22107 | cCas9-v42 | 70 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 797 | GCAG | TCCATGTCTGATGTACTGTGT | 22108 | SauriCas9-KKH | 70 | 0 |
| 798 | GCA | CCATGTCTGATGTACTGTGT | 22109 | SpyCas9-SpRY | 70 | 0 |
| 799 | CTC | AGGTCTCCTAGTGCCTCTGA | 22110 | SpyCas9-SpRY | 70 | 0 |
| 800 | GCAGTG | TCCATGTCTGATGTACTGTGT | 22111 | cCas9-v16 | 70 | 0 |
| 801 | GCAGTG | TCCATGTCTGATGTACTGTGT | 22112 | cCas9-v21 | 70 | 0 |
| 802 | TGCAG | ATCCATGTCTGATGTACTGTG | 22113 | SauCas9KKH | 71 | 0 |
| 803 | TGCAGT | ATCCATGTCTGATGTACTGTG | 22114 | SauCas9KKH | 71 | 0 |
| 804 | TGCAGT | ATCCATGTCTGATGTACTGTG | 22115 | cCas9-v17 | 71 | 0 |
| 805 | TGCAGT | ATCCATGTCTGATGTACTGTG | 22116 | cCas9-v42 | 71 | 0 |
| 806 | TG | TCCATGTCTGATGTACTGTG | 22117 | SpyCas9-NG | 71 | 0 |
| 807 | TG | TCCATGTCTGATGTACTGTG | 22118 | SpyCas9-xCas | 71 | 0 |
| 808 | TG | TCCATGTCTGATGTACTGTG | 22119 | SpyCas9-xCas-NG | 71 | 0 |
| 809 | TGC | TCCATGTCTGATGTACTGTG | 22120 | SpyCas9-SpG | 71 | 0 |
| 810 | TGC | TCCATGTCTGATGTACTGTG | 22121 | SpyCas9-SpRY | 71 | 0 |
| 811 | ACT | AAGGTCTCCTAGTGCCTCTG | 22122 | SpyCas9-SpRY | 71 | 0 |
| 812 | TGCA | TCCATGTCTGATGTACTGTG | 22123 | SpyCas9-3var-NRCH | 71 | 0 |
| 813 | GTG | ATCCATGTCTGATGTACTGT | 22124 | ScaCas9 | 72 | 0 |
| 814 | GTG | ATCCATGTCTGATGTACTGT | 22125 | ScaCas9-HiFi-Sc++ | 72 | 0 |
| 815 | GTG | ATCCATGTCTGATGTACTGT | 22126 | ScaCas9-Sc++ | 72 | 0 |
| 816 | GTG | ATCCATGTCTGATGTACTGT | 22127 | SpyCas9-SpRY | 72 | 0 |
| 817 | GAC | AAAGGTCTCCTAGTGCCTCT | 22128 | SpyCas9-SpRY | 72 | 0 |
| 818 | GACTCAGT | cctaAAGGTCTCCTAGTGCCTCT | 22129 | BlatCas9 | 72 | 0 |
| 819 | GACTC | cctaAAGGTCTCCTAGTGCCTCT | 22130 | BlatCas9 | 72 | 0 |
| 820 | GACT | AAAGGTCTCCTAGTGCCTCT | 22131 | SpyCas9-3var-NRCH | 72 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 821 | TG | GATCCATGTCTGATGTACTG | 22132 | SpyCas9-NG | 73 | 0 |
| 822 | TG | GATCCATGTCTGATGTACTG | 22133 | SpyCas9-xCas | 73 | 0 |
| 823 | TG | GATCCATGTCTGATGTACTG | 22134 | SpyCas9-xCas-NG | 73 | 0 |
| 824 | TG | TAAAGGTCTCCTAGTGCCTC | 22135 | SpyCas9-NG | 73 | 0 |
| 825 | TG | TAAAGGTCTCCTAGTGCCTC | 22136 | SpyCas9-xCas | 73 | 0 |
| 826 | TG | TAAAGGTCTCCTAGTGCCTC | 22137 | SpyCas9-xCas-NG | 73 | 0 |
| 827 | TGT | GATCCATGTCTGATGTACTG | 22138 | SpyCas9-SpG | 73 | 0 |
| 828 | TGT | GATCCATGTCTGATGTACTG | 22139 | SpyCas9-SpRY | 73 | 0 |
| 829 | TGA | TAAAGGTCTCCTAGTGCCTC | 22140 | SpyCas9-SpG | 73 | 0 |
| 830 | TGA | TAAAGGTCTCCTAGTGCCTC | 22141 | SpyCas9-SpRY | 73 | 0 |
| 831 | TGTGCAGT | ttggATCCATGTCTGATGTACTG | 22142 | BlatCas9 | 73 | 0 |
| 832 | TGTGC | ttggATCCATGTCTGATGTACTG | 22143 | BlatCas9 | 73 | 0 |
| 833 | TGAC | TAAAGGTCTCCTAGTGCCTC | 22144 | SpyCas9-3var-NRRH | 73 | 0 |
| 834 | TGAC | TAAAGGTCTCCTAGTGCCTC | 22145 | SpyCas9-VQR | 73 | 0 |
| 835 | GTG | GGATCCATGTCTGATGTACT | 22146 | ScaCas9 | 74 | 0 |
| 836 | GTG | GGATCCATGTCTGATGTACT | 22147 | ScaCas9-HiFi-Sc++ | 74 | 0 |
| 837 | GTG | GGATCCATGTCTGATGTACT | 22148 | ScaCas9-Sc++ | 74 | 0 |
| 838 | GTG | GGATCCATGTCTGATGTACT | 22149 | SpyCas9-SpRY | 74 | 0 |
| 839 | CTG | CTAAAGGTCTCCTAGTGCCT | 22150 | ScaCas9 | 74 | 0 |
| 840 | CTG | CTAAAGGTCTCCTAGTGCCT | 22151 | ScaCas9-HiFi-Sc++ | 74 | 0 |
| 841 | CTG | CTAAAGGTCTCCTAGTGCCT | 22152 | ScaCas9-Sc++ | 74 | 0 |
| 842 | CTG | CTAAAGGTCTCCTAGTGCCT | 22153 | SpyCas9-SpRY | 74 | 0 |
| 843 | CTGAC | taccTAAAGGTCTCCTAGTGCCT | 22154 | BlatCas9 | 74 | 0 |
| 844 | CTGACT | CCTAAAGGTCTCCTAGTGCCT | 22155 | cCas9-v16 | 74 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 845 | CTGACT | CCTAAAGGTCTCCTAGTGCCT | 22156 | cCas9-v21 | 74 | 0 |
| 846 | CTGACTC | ACCTAAAGGTCTCCTAGTGCCT | 22157 | CdiCas9 | 74 | 0 |
| 847 | TCTGA | ACCTAAAGGTCTCCTAGTGCC | 22158 | SauCas9KKH | 75 | 0 |
| 848 | TG | TGGATCCATGTCTGATGTAC | 22159 | SpyCas9-NG | 75 | 0 |
| 849 | TG | TGGATCCATGTCTGATGTAC | 22160 | SpyCas9-xCas | 75 | 0 |
| 850 | TG | TGGATCCATGTCTGATGTAC | 22161 | SpyCas9-xCas-NG | 75 | 0 |
| 851 | TGT | TGGATCCATGTCTGATGTAC | 22162 | SpyCas9-SpG | 75 | 0 |
| 852 | TGT | TGGATCCATGTCTGATGTAC | 22163 | SpyCas9-SpRY | 75 | 0 |
| 853 | TCT | CCTAAAGGTCTCCTAGTGCC | 22164 | SpyCas9-SpRY | 75 | 0 |
| 854 | CTG | TTGGATCCATGTCTGATGTA | 22165 | ScaCas9 | 76 | 0 |
| 855 | CTG | TTGGATCCATGTCTGATGTA | 22166 | ScaCas9-HiFi-Sc++ | 76 | 0 |
| 856 | CTG | TTGGATCCATGTCTGATGTA | 22167 | ScaCas9-Sc++ | 76 | 0 |
| 857 | CTG | TTGGATCCATGTCTGATGTA | 22168 | SpyCas9-SpRY | 76 | 0 |
| 858 | CTC | ACCTAAAGGTCTCCTAGTGC | 22169 | SpyCas9-SpRY | 76 | 0 |
| 859 | CTCTGACT | cactACCTAAAGGTCTCCTAGTGC | 22170 | NmeCas9 | 76 | 0 |
| 860 | ACT | CTTGGATCCATGTCTGATGT | 22171 | SpyCas9-SpRY | 77 | 0 |
| 861 | CCT | TACCTAAAGGTCTCCTAGTG | 22172 | SpyCas9-SpRY | 77 | 0 |
| 862 | TAC | GCTTGGATCCATGTCTGATG | 22173 | SpyCas9-SpRY | 78 | 0 |
| 863 | GCC | CTACCTAAAGGTCTCCTAGT | 22174 | SpyCas9-SpRY | 78 | 0 |
| 864 | GCCTCTGA | ccacTACCTAAAGGTCTCCTAGT | 22175 | BlatCas9 | 78 | 0 |
| 865 | GCCTC | ccacTACCTAAAGGTCTCCTAGT | 22176 | BlatCas9 | 78 | 0 |
| 866 | TACT | GCTTGGATCCATGTCTGATG | 22177 | SpyCas9-3var-NRCH | 78 | 0 |
| 867 | TG | ACTACCTAAAGGTCTCCTAG | 22178 | SpyCas9-NG | 79 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 868 | TG | ACTACCTAAAGGTCTCCTAG | 22179 | SpyCas9-xCas | 79 | 0 |
| 869 | TG | ACTACCTAAAGGTCTCCTAG | 22180 | SpyCas9-xCas-NG | 79 | 0 |
| 870 | TGC | ACTACCTAAAGGTCTCCTAG | 22181 | SpyCas9-SpG | 79 | 0 |
| 871 | TGC | ACTACCTAAAGGTCTCCTAG | 22182 | SpyCas9-SpRY | 79 | 0 |
| 872 | GTA | GGCTTGGATCCATGTCTGAT | 22183 | SpyCas9-SpRY | 79 | 0 |
| 873 | TGCC | ACTACCTAAAGGTCTCCTAG | 22184 | SpyCas9-3var-NRCH | 79 | 0 |
| 874 | GTG | CACTACCTAAAGGTCTCCTA | 22185 | ScaCas9 | 80 | 0 |
| 875 | GTG | CACTACCTAAAGGTCTCCTA | 22186 | ScaCas9-HiFi-Sc++ | 80 | 0 |
| 876 | GTG | CACTACCTAAAGGTCTCCTA | 22187 | ScaCas9-Sc++ | 80 | 0 |
| 877 | GTG | CACTACCTAAAGGTCTCCTA | 22188 | SpyCas9-SpRY | 80 | 0 |
| 878 | TG | GGGCTTGGATCCATGTCTGA | 22189 | SpyCas9-NG | 80 | 0 |
| 879 | TG | GGGCTTGGATCCATGTCTGA | 22190 | SpyCas9-xCas | 80 | 0 |
| 880 | TG | GGGCTTGGATCCATGTCTGA | 22191 | SpyCas9-xCas-NG | 80 | 0 |
| 881 | TGT | GGGCTTGGATCCATGTCTGA | 22192 | SpyCas9-SpG | 80 | 0 |
| 882 | TGT | GGGCTTGGATCCATGTCTGA | 22193 | SpyCas9-SpRY | 80 | 0 |
| 883 | TGTACTGT | catgGGCTTGGATCCATGTCTGA | 22194 | BlatCas9 | 80 | 0 |
| 884 | TGTAC | catgGGCTTGGATCCATGTCTGA | 22195 | BlatCas9 | 80 | 0 |
| 885 | GTGCC | ctccACTACCTAAAGGTCTCCTA | 22196 | BlatCas9 | 80 | 0 |
| 886 | GTGCCTC | TCCACTACCTAAAGGTCTCCTA | 22197 | CdiCas9 | 80 | 0 |
| 887 | TGTA | GGGCTTGGATCCATGTCTGA | 22198 | SpyCas9-3var-NRTH | 80 | 0 |
| 888 | AGTGCC | taCTCCACTACCTAAAGGTCTCCT | 22199 | Nme2Cas9 | 81 | 0 |
| 889 | ATG | TGGGCTTGGATCCATGTCTG | 22200 | ScaCas9 | 81 | 0 |
| 890 | ATG | TGGGCTTGGATCCATGTCTG | 22201 | ScaCas9-HiFi-Sc++ | 81 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 891 | ATG | TGGGCTTGGATCCATGTCTG | 22202 | ScaCas9-Sc++ | 81 | 0 |
| 892 | ATG | TGGGCTTGGATCCATGTCTG | 22203 | SpyCas9-SpRY | 81 | 0 |
| 893 | AG | CCACTACCTAAAGGTCTCCT | 22204 | SpyCas9-NG | 81 | 0 |
| 894 | AG | CCACTACCTAAAGGTCTCCT | 22205 | SpyCas9-xCas | 81 | 0 |
| 895 | AG | CCACTACCTAAAGGTCTCCT | 22206 | SpyCas9-xCas-NG | 81 | 0 |
| 896 | AGT | CCACTACCTAAAGGTCTCCT | 22207 | SpyCas9-SpG | 81 | 0 |
| 897 | AGT | CCACTACCTAAAGGTCTCCT | 22208 | SpyCas9-SpRY | 81 | 0 |
| 898 | AGTGC | actcCACTACCTAAAGGTCTCCT | 22209 | BlatCas9 | 81 | 0 |
| 899 | ATGTACT | CATGGGCTTGGATCCATGTCTG | 22210 | CdiCas9 | 81 | 0 |
| 900 | TAG | TCCACTACCTAAAGGTCTCC | 22211 | ScaCas9 | 82 | 0 |
| 901 | TAG | TCCACTACCTAAAGGTCTCC | 22212 | ScaCas9-HiFi-Sc++ | 82 | 0 |
| 902 | TAG | TCCACTACCTAAAGGTCTCC | 22213 | ScaCas9-Sc++ | 82 | 0 |
| 903 | TAG | TCCACTACCTAAAGGTCTCC | 22214 | SpyCas9-SpRY | 82 | 0 |
| 904 | GAT | ATGGGCTTGGATCCATGTCT | 22215 | SpyCas9-SpRY | 82 | 0 |
| 905 | GAT | ATGGGCTTGGATCCATGTCT | 22216 | SpyCas9-xCas | 82 | 0 |
| 906 | TAGT | TCCACTACCTAAAGGTCTCC | 22217 | SpyCas9-3var-NRRH | 82 | 0 |
| 907 | CTAG | ACTCCACTACCTAAAGGTCTC | 22218 | SauriCas9-KKH | 83 | 0 |
| 908 | TG | CATGGGCTTGGATCCATGTC | 22219 | SpyCas9-NG | 83 | 0 |
| 909 | TG | CATGGGCTTGGATCCATGTC | 22220 | SpyCas9-xCas | 83 | 0 |
| 910 | TG | CATGGGCTTGGATCCATGTC | 22221 | SpyCas9-xCas-NG | 83 | 0 |
| 911 | TGA | CATGGGCTTGGATCCATGTC | 22222 | SpyCas9-SpG | 83 | 0 |
| 912 | TGA | CATGGGCTTGGATCCATGTC | 22223 | SpyCas9-SpRY | 83 | 0 |
| 913 | CTA | CTCCACTACCTAAAGGTCTC | 22224 | SpyCas9-SpRY | 83 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 914 | CTAGTG | ACTCCACTACCTAAAGGTCTC | 22225 | cCas9-v16 | 83 | 0 |
| 915 | CTAGTG | ACTCCACTACCTAAAGGTCTC | 22226 | cCas9-v21 | 83 | 0 |
| 916 | TGATGTAC | atACATGGGCTTGGATCCATGTC | 22227 | CjeCas9 | 83 | 0 |
| 917 | TGAT | CATGGGCTTGGATCCATGTC | 22228 | SpyCas9-3var-NRRH | 83 | 0 |
| 918 | TGAT | CATGGGCTTGGATCCATGTC | 22229 | SpyCas9-VQR | 83 | 0 |
| 919 | CCTAG | TACTCCACTACCTAAAGGTCT | 22230 | SauCas9KKH | 84 | 0 |
| 920 | CCTAGT | TACTCCACTACCTAAAGGTCT | 22231 | SauCas9KKH | 84 | 0 |
| 921 | CTG | ACATGGGCTTGGATCCATGT | 22232 | ScaCas9 | 84 | 0 |
| 922 | CTG | ACATGGGCTTGGATCCATGT | 22233 | ScaCas9-HiFi-Sc++ | 84 | 0 |
| 923 | CTG | ACATGGGCTTGGATCCATGT | 22234 | ScaCas9-Sc++ | 84 | 0 |
| 924 | CTG | ACATGGGCTTGGATCCATGT | 22235 | SpyCas9-SpRY | 84 | 0 |
| 925 | CCT | ACTCCACTACCTAAAGGTCT | 22236 | SpyCas9-SpRY | 84 | 0 |
| 926 | TCTGA | ATACATGGGCTTGGATCCATG | 22237 | SauCas9KKH | 85 | 0 |
| 927 | TCTGAT | ATACATGGGCTTGGATCCATG | 22238 | SauCas9KKH | 85 | 0 |
| 928 | TCT | TACATGGGCTTGGATCCATG | 22239 | SpyCas9-SpRY | 85 | 0 |
| 929 | TCC | TACTCCACTACCTAAAGGTC | 22240 | SpyCas9-SpRY | 85 | 0 |
| 930 | GTC | ATACATGGGCTTGGATCCAT | 22241 | SpyCas9-SpRY | 86 | 0 |
| 931 | CTC | CTACTCCACTACCTAAAGGT | 22242 | SpyCas9-SpRY | 86 | 0 |
| 932 | TG | TATACATGGGCTTGGATCCA | 22243 | SpyCas9-NG | 87 | 0 |
| 933 | TG | TATACATGGGCTTGGATCCA | 22244 | SpyCas9-xCas | 87 | 0 |
| 934 | TG | TATACATGGGCTTGGATCCA | 22245 | SpyCas9-xCas-NG | 87 | 0 |
| 935 | TGT | TATACATGGGCTTGGATCCA | 22246 | SpyCas9-SpG | 87 | 0 |
| 936 | TGT | TATACATGGGCTTGGATCCA | 22247 | SpyCas9-SpRY | 87 | 0 |
| 937 | TCT | ACTACTCCACTACCTAAAGG | 22248 | SpyCas9-SpRY | 87 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 938 | TCTCCTAG | tgtaCTACTCCACTACCTAAAGG | 22249 | BlatCas9 | 87 | 0 |
| 939 | TCTCC | tgtaCTACTCCACTACCTAAAGG | 22250 | BlatCas9 | 87 | 0 |
| 940 | TGTC | TATACATGGGCTTGGATCCA | 22251 | SpyCas9-3var-NRTH | 87 | 0 |
| 941 | GTCTCC | tgTGTACTACTCCACTACCTAAAG | 22252 | Nme2Cas9 | 88 | 0 |
| 942 | ATG | GTATACATGGGCTTGGATCC | 22253 | ScaCas9 | 88 | 0 |
| 943 | ATG | GTATACATGGGCTTGGATCC | 22254 | ScaCas9-HiFi-Sc++ | 88 | 0 |
| 944 | ATG | GTATACATGGGCTTGGATCC | 22255 | ScaCas9-Sc++ | 88 | 0 |
| 945 | ATG | GTATACATGGGCTTGGATCC | 22256 | SpyCas9-SpRY | 88 | 0 |
| 946 | GTC | TACTACTCCACTACCTAAAG | 22257 | SpyCas9-SpRY | 88 | 0 |
| 947 | ATGTCTGA | ggggTATACATGGGCTTGGATCC | 22258 | BlatCas9 | 88 | 0 |
| 948 | GTCTCCTA | gtgtACTACTCCACTACCTAAAG | 22259 | BlatCas9 | 88 | 0 |
| 949 | ATGTC | ggggTATACATGGGCTTGGATCC | 22260 | BlatCas9 | 88 | 0 |
| 950 | GTCTC | gtgtACTACTCCACTACCTAAAG | 22261 | BlatCas9 | 88 | 0 |
| 951 | GG | GTACTACTCCACTACCTAAA | 22262 | SpyCas9-NG | 89 | 0 |
| 952 | GG | GTACTACTCCACTACCTAAA | 22263 | SpyCas9-xCas | 89 | 0 |
| 953 | GG | GTACTACTCCACTACCTAAA | 22264 | SpyCas9-xCas-NG | 89 | 0 |
| 954 | CAT | GGTATACATGGGCTTGGATC | 22265 | SpyCas9-SpRY | 89 | 0 |
| 955 | GGT | GTACTACTCCACTACCTAAA | 22266 | SpyCas9-SpG | 89 | 0 |
| 956 | GGT | GTACTACTCCACTACCTAAA | 22267 | SpyCas9-SpRY | 89 | 0 |
| 957 | GGTC | GTACTACTCCACTACCTAAA | 22268 | SpyCas9-3var-NRTH | 89 | 0 |
| 958 | AGG | TGTACTACTCCACTACCTAA | 22269 | ScaCas9 | 90 | 0 |
| 959 | AGG | TGTACTACTCCACTACCTAA | 22270 | ScaCas9-HiFi-Sc++ | 90 | 0 |
| 960 | AGG | TGTACTACTCCACTACCTAA | 22271 | ScaCas9-Sc++ | 90 | 0 |
| 961 | AGG | TGTACTACTCCACTACCTAA | 22272 | SpyCas9 | 90 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 962 | AGG | TGTACTACTCCACTACCTAA | 22273 | SpyCas9-HF1 | 90 | 0 |
| 963 | AGG | TGTACTACTCCACTACCTAA | 22274 | SpyCas9-SpG | 90 | 0 |
| 964 | AGG | TGTACTACTCCACTACCTAA | 22275 | SpyCas9-SpRY | 90 | 0 |
| 965 | AG | TGTACTACTCCACTACCTAA | 22276 | SpyCas9-NG | 90 | 0 |
| 966 | AG | TGTACTACTCCACTACCTAA | 22277 | SpyCas9-xCas | 90 | 0 |
| 967 | AG | TGTACTACTCCACTACCTAA | 22278 | SpyCas9-xCas-NG | 90 | 0 |
| 968 | CCA | GGGTATACATGGGCTTGGAT | 22279 | SpyCas9-SpRY | 90 | 0 |
| 969 | AGGTC | atgtGTACTACTCCACTACCTAA | 22280 | BlatCas9 | 90 | 0 |
| 970 | AGGTCTC | TGTGTACTACTCCACTACCTAA | 22281 | CdiCas9 | 90 | 0 |
| 971 | CCATGTCT | tcggGGGTATACATGGGCTTGGAT | 22282 | NmeCas9 | 90 | 0 |
| 972 | AGGT | TGTACTACTCCACTACCTAA | 22283 | SpyCas9-3var-NRRH | 90 | 0 |
| 973 | AAGG | TGTGTACTACTCCACTACCTA | 22284 | SauriCas9 | 91 | 0 |
| 974 | AAGG | TGTGTACTACTCCACTACCTA | 22285 | SauriCas9-KKH | 91 | 0 |
| 975 | AAG | GTGTACTACTCCACTACCTA | 22286 | ScaCas9 | 91 | 0 |
| 976 | AAG | GTGTACTACTCCACTACCTA | 22287 | ScaCas9-HiFi-Sc++ | 91 | 0 |
| 977 | AAG | GTGTACTACTCCACTACCTA | 22288 | ScaCas9-Sc++ | 91 | 0 |
| 978 | AAG | GTGTACTACTCCACTACCTA | 22289 | SpyCas9-SpRY | 91 | 0 |
| 979 | TCC | GGGGTATACATGGGCTTGGA | 22290 | SpyCas9-SpRY | 91 | 0 |
| 980 | AAAGG | ATGTGTACTACTCCACTACCT | 22291 | SauCas9KKH | 92 | 0 |
| 981 | AAAGGT | ATGTGTACTACTCCACTACCT | 22292 | SauCas9KKH | 92 | 0 |
| 982 | AAAGGT | ATGTGTACTACTCCACTACCT | 22293 | cCas9-v17 | 92 | 0 |
| 983 | AAAGGT | ATGTGTACTACTCCACTACCT | 22294 | cCas9-v42 | 92 | 0 |
| 984 | AAAG | ATGTGTACTACTCCACTACCT | 22295 | SauriCas9-KKH | 92 | 0 |
| 985 | AAAG | TGTGTACTACTCCACTACCT | 22296 | SpyCas9-QQR1 | 92 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 986 | AAAG | atGTGTACTACTCCACTACCT | 22297 | iSpyMacCas9 | 92 | 0 |
| 987 | AAA | TGTGTACTACTCCACTACCT | 22298 | SpyCas9-SpRY | 92 | 0 |
| 988 | ATC | GGGGGTATACATGGGCTTGG | 22299 | SpyCas9-SpRY | 92 | 0 |
| 989 | AAAGGTCT | gttaTGTGTACTACTCCACTACCT | 22300 | NmeCas9 | 92 | 0 |
| 990 | TAAAG | TATGTGTACTACTCCACTACC | 22301 | SauCas9KKH | 93 | 0 |
| 991 | GAT | CGGGGGTATACATGGGCTTG | 22302 | SpyCas9-SpRY | 93 | 0 |
| 992 | GAT | CGGGGGTATACATGGGCTTG | 22303 | SpyCas9-xCas | 93 | 0 |
| 993 | TAA | ATGTGTACTACTCCACTACC | 22304 | SpyCas9-SpRY | 93 | 0 |
| 994 | GATCCATG | gttcGGGGGTATACATGGGCTTG | 22305 | BlatCas9 | 93 | 0 |
| 995 | GATCC | gttcGGGGGTATACATGGGCTTG | 22306 | BlatCas9 | 93 | 0 |
| 996 | TAAAGG | TATGTGTACTACTCCACTACC | 22307 | cCas9-v17 | 93 | 0 |
| 997 | TAAAGG | TATGTGTACTACTCCACTACC | 22308 | cCas9-v42 | 93 | 0 |
| 998 | TAAA | ATGTGTACTACTCCACTACC | 22309 | SpyCas9-3var-NRRH | 93 | 0 |
| 999 | TAAA | taTGTGTACTACTCCACTACC | 22310 | iSpyMacCas9 | 93 | 0 |
| 1000 | GATC | CGGGGGTATACATGGGCTTG | 22311 | SpyCas9-3var-NRTH | 93 | 0 |
| 1001 | GGATCC | cgGTTCGGGGGTATACATGGGCTT | 22312 | Nme2Cas9 | 94 | 0 |
| 1002 | CTAAA | TTATGTGTACTACTCCACTAC | 22313 | SauCas9KKH | 94 | 0 |
| 1003 | GG | TCGGGGGTATACATGGGCTT | 22314 | SpyCas9-NG | 94 | 0 |
| 1004 | GG | TCGGGGGTATACATGGGCTT | 22315 | SpyCas9-xCas | 94 | 0 |
| 1005 | GG | TCGGGGGTATACATGGGCTT | 22316 | SpyCas9-xCas-NG | 94 | 0 |
| 1006 | GGA | TCGGGGGTATACATGGGCTT | 22317 | SpyCas9-SpG | 94 | 0 |
| 1007 | GGA | TCGGGGGTATACATGGGCTT | 22318 | SpyCas9-SpRY | 94 | 0 |
| 1008 | CTA | TATGTGTACTACTCCACTAC | 22319 | SpyCas9-SpRY | 94 | 0 |
| 1009 | GGATCCAT | ggttCGGGGGTATACATGGGCTT | 22320 | BlatCas9 | 94 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 1010 | GGATC | ggttCGGGGGTATACATGGGCTT | 22321 | BlatCas9 | 94 | 0 |
| 1011 | CTAAAG | TTATGTGTACTACTCCACTAC | 22322 | cCas9-v17 | 94 | 0 |
| 1012 | CTAAAG | TTATGTGTACTACTCCACTAC | 22323 | cCas9-v42 | 94 | 0 |
| 1013 | GGAT | TCGGGGGTATACATGGGCTT | 22324 | SpyCas9-3var-NRRH | 94 | 0 |
| 1014 | GGAT | TCGGGGGTATACATGGGCTT | 22325 | SpyCas9-VQR | 94 | 0 |
| 1015 | CCTAA | GTTATGTGTACTACTCCACTA | 22326 | SauCas9KKH | 95 | 0 |
| 1016 | TGG | TTCGGGGGTATACATGGGCT | 22327 | ScaCas9 | 95 | 0 |
| 1017 | TGG | TTCGGGGGTATACATGGGCT | 22328 | ScaCas9-HiFi-Sc++ | 95 | 0 |
| 1018 | TGG | TTCGGGGGTATACATGGGCT | 22329 | ScaCas9-Sc++ | 95 | 0 |
| 1019 | TGG | TTCGGGGGTATACATGGGCT | 22330 | SpyCas9 | 95 | 0 |
| 1020 | TGG | TTCGGGGGTATACATGGGCT | 22331 | SpyCas9-HF1 | 95 | 0 |
| 1021 | TGG | TTCGGGGGTATACATGGGCT | 22332 | SpyCas9-SpG | 95 | 0 |
| 1022 | TGG | TTCGGGGGTATACATGGGCT | 22333 | SpyCas9-SpRY | 95 | 0 |
| 1023 | TG | TTCGGGGGTATACATGGGCT | 22334 | SpyCas9-NG | 95 | 0 |
| 1024 | TG | TTCGGGGGTATACATGGGCT | 22335 | SpyCas9-xCas | 95 | 0 |
| 1025 | TG | TTCGGGGGTATACATGGGCT | 22336 | SpyCas9-xCas-NG | 95 | 0 |
| 1026 | CCT | TTATGTGTACTACTCCACTA | 22337 | SpyCas9-SpRY | 95 | 0 |
| 1027 | TGGATCC | GGTTCGGGGGTATACATGGGCT | 22338 | CdiCas9 | 95 | 0 |
| 1028 | TGGA | TTCGGGGGTATACATGGGCT | 22339 | SpyCas9-3var-NRRH | 95 | 0 |
| 1029 | TTGGA | acGGTTCGGGGGTATACATGGGC | 22340 | SauCas9 | 96 | 0 |
| 1030 | TTGGA | GGTTCGGGGGTATACATGGGC | 22341 | SauCas9KKH | 96 | 0 |
| 1031 | TTGGAT | acGGTTCGGGGGTATACATGGGC | 22342 | SauCas9 | 96 | 0 |
| 1032 | TTGGAT | GGTTCGGGGGTATACATGGGC | 22343 | SauCas9KKH | 96 | 0 |
| 1033 | TTGGAT | GGTTCGGGGGTATACATGGGC | 22344 | cCas9-v17 | 96 | 0 |
| 1034 | TTGGAT | GGTTCGGGGGTATACATGGGC | 22345 | cCas9-v42 | 96 | 0 |
| 1035 | TTGG | GGTTCGGGGGTATACATGGGC | 22346 | SauriCas9 | 96 | 0 |

TABLE 1C-continued

Exemplary gRNA spacer Cas pairs for correcting the pathogenic R243Q mutation
Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 ("ID") is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 1036 | TTGG | GGTTCGGGGGTATACATGGGC | 22347 | SauriCas9-KKH | 96 | 0 |
| 1037 | TTG | GTTCGGGGGTATACATGGGC | 22348 | ScaCas9 | 96 | 0 |
| 1038 | TTG | GTTCGGGGGTATACATGGGC | 22349 | ScaCas9-HiFi-Sc++ | 96 | 0 |
| 1039 | TTG | GTTCGGGGGTATACATGGGC | 22350 | ScaCas9-Sc++ | 96 | 0 |
| 1040 | TTG | GTTCGGGGGTATACATGGGC | 22351 | SpyCas9-SpRY | 96 | 0 |
| 1041 | ACC | GTTATGTGTACTACTCCACT | 22352 | SpyCas9-SpRY | 96 | 0 |
| 1042 | CTTGG | CGGTTCGGGGGTATACATGGG | 22353 | SauCas9KKH | 97 | 0 |
| 1043 | TAC | AGTTATGTGTACTACTCCAC | 22354 | SpyCas9-SpRY | 97 | 0 |
| 1044 | CTT | GGTTCGGGGGTATACATGGG | 22355 | SpyCas9-SpRY | 97 | 0 |
| 1045 | TACC | AGTTATGTGTACTACTCCAC | 22356 | SpyCas9-3var-NRCH | 97 | 0 |
| 1046 | GCT | CGGTTCGGGGGTATACATGG | 22357 | SpyCas9-SpRY | 98 | 0 |
| 1047 | CTA | CAGTTATGTGTACTACTCCA | 22358 | SpyCas9-SpRY | 98 | 0 |
| 1048 | CTACCTAA | gggcAGTTATGTGTACTACTCCA | 22359 | BlatCas9 | 98 | 0 |
| 1049 | CTACCTAA | gggcAGTTATGTGTACTACTCCA | 22360 | BlatCas9 | 98 | 0 |
| 1050 | CTACC | gggcAGTTATGTGTACTACTCCA | 22361 | BlatCas9 | 98 | 0 |
| 1051 | ACTACC | ctGGGCAGTTATGTGTACTACTCC | 22362 | Nme2Cas9 | 99 | 0 |
| 1052 | GG | ACGGTTCGGGGGTATACATG | 22363 | SpyCas9-NG | 99 | 0 |
| 1053 | GG | ACGGTTCGGGGGTATACATG | 22364 | SpyCas9-xCas | 99 | 0 |
| 1054 | GG | ACGGTTCGGGGGTATACATG | 22365 | SpyCas9-xCas-NG | 99 | 0 |
| 1055 | GGC | ACGGTTCGGGGGTATACATG | 22366 | SpyCas9-SpG | 99 | 0 |
| 1056 | GGC | ACGGTTCGGGGGTATACATG | 22367 | SpyCas9-SpRY | 99 | 0 |
| 1057 | ACT | GCAGTTATGTGTACTACTCC | 22368 | SpyCas9-SpRY | 99 | 0 |

TABLE 1C-continued

Exemplary gRNA spacer Cas pairs for correcting the pathogenic R243Q mutation

Table 1C provides a gRNA database for correcting the pathogenic R243Q mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2C, 3C, and 4C detail the other components of the system and are organized such that the ID number shown here in Column 1 (“ID”) is meant to correspond to the same ID number in Tables 2C, 2C, and 4C.

| ID | PAM sequence | gRNA spacer | SEQ ID NO | Cas species | distance | Overlaps mutation |
|---|---|---|---|---|---|---|
| 1058 | ACTACCT A | tgggCAGTTATGTGTACTACTCC | 22369 | BlatCas9 | 99 | 0 |
| 1059 | ACTAC | tgggCAGTTATGTGTACTACTCC | 22370 | BlatCas9 | 99 | 0 |
| 1060 | GGCT | ACGGTTCGGGGGTATACATG | 22371 | SpyCas9-3var-NRCH | 99 | 0 |
| 1061 | GGG | CACGGTTCGGGGGTATACAT | 22372 | ScaCas9 | 100 | 0 |
| 1062 | GGG | CACGGTTCGGGGGTATACAT | 22373 | ScaCas9-HiFi-Sc++ | 100 | 0 |
| 1063 | GGG | CACGGTTCGGGGGTATACAT | 22374 | ScaCas9-Sc++ | 100 | 0 |
| 1064 | GGG | CACGGTTCGGGGGTATACAT | 22375 | SpyCas9 | 100 | 0 |
| 1065 | GGG | CACGGTTCGGGGGTATACAT | 22376 | SpyCas9-HF1 | 100 | 0 |
| 1066 | GGG | CACGGTTCGGGGGTATACAT | 22377 | SpyCas9-SpG | 100 | 0 |
| 1067 | GGG | CACGGTTCGGGGGTATACAT | 22378 | SpyCas9-SpRY | 100 | 0 |
| 1068 | GG | CACGGTTCGGGGGTATACAT | 22379 | SpyCas9-NG | 100 | 0 |
| 1069 | GG | CACGGTTCGGGGGTATACAT | 22380 | SpyCas9-xCas | 100 | 0 |
| 1070 | GG | CACGGTTCGGGGGTATACAT | 22381 | SpyCas9-xCas-NG | 100 | 0 |
| 1071 | CAC | GGCAGTTATGTGTACTACTC | 22382 | SpyCas9-SpRY | 100 | 0 |
| 1072 | GGGC | CACGGTTCGGGGGTATACAT | 22383 | SpyCas9-3var-NRRH | 100 | 0 |
| 1073 | CACT | GGCAGTTATGTGTACTACTC | 22384 | SpyCas9-3var-NRCH | 100 | 0 |

TABLE 1D

Exemplary gRNA spacer Cas pairs for correcting the pathogenic IVS10-11G > A mutation Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 1 | GCC | ATAATAACTTTTCACTTAGG | 23599 | SpyCas9-SpRY | 0 | 0 |

TABLE 1D-continued

Exemplary gRNA spacer Cas pairs for correcting the pathogenic IVS10-11G > A mutation Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 2 | AGTGA | TAAGCAGTACTGTAGGCCCTA | 23600 | SauCas9KKH | 1 | 0 |
| 3 | GG | GATAATAACTTTTCACTTAG | 23601 | SpyCas9-NG | 1 | 0 |
| 4 | GG | GATAATAACTTTTCACTTAG | 23602 | SpyCas9-xCas | 1 | 0 |
| 5 | GG | GATAATAACTTTTCACTTAG | 23603 | SpyCas9-xCas-NG | 1 | 0 |
| 6 | AG | AAGCAGTACTGTAGGCCCTA | 23604 | SpyCas9-NG | 1 | 0 |
| 7 | AG | AAGCAGTACTGTAGGCCCTA | 23605 | SpyCas9-xCas | 1 | 0 |
| 8 | AG | AAGCAGTACTGTAGGCCCTA | 23606 | SpyCas9-xCas-NG | 1 | 0 |
| 9 | GGC | GATAATAACTTTTCACTTAG | 23607 | SpyCas9-SpG | 1 | 0 |
| 10 | GGC | GATAATAACTTTTCACTTAG | 23608 | SpyCas9-SpRY | 1 | 0 |
| 11 | AGT | AAGCAGTACTGTAGGCCCTA | 23609 | SpyCas9-SpG | 1 | 0 |
| 12 | AGT | AAGCAGTACTGTAGGCCCTA | 23610 | SpyCas9-SpRY | 1 | 0 |
| 13 | GGCC | GATAATAACTTTTCACTTAG | 23611 | SpyCas9-3var-NRCH | 1 | 0 |
| 14 | GGG | TGATAATAACTTTTCACTTA | 23612 | ScaCas9 | 2 | 0 |
| 15 | GGG | TGATAATAACTTTTCACTTA | 23613 | ScaCas9-HiFi-Sc++ | 2 | 0 |
| 16 | GGG | TGATAATAACTTTTCACTTA | 23614 | ScaCas9-Sc++ | 2 | 0 |
| 17 | GGG | TGATAATAACTTTTCACTTA | 23615 | SpyCas9 | 2 | 0 |
| 18 | GGG | TGATAATAACTTTTCACTTA | 23616 | SpyCas9-HF1 | 2 | 0 |
| 19 | GGG | TGATAATAACTTTTCACTTA | 23617 | SpyCas9-SpG | 2 | 0 |
| 20 | GGG | TGATAATAACTTTTCACTTA | 23618 | SpyCas9-SpRY | 2 | 0 |
| 21 | AAG | TAAGCAGTACTGTAGGCCCT | 23619 | ScaCas9 | 2 | 0 |
| 22 | AAG | TAAGCAGTACTGTAGGCCCT | 23620 | ScaCas9-HiFi-Sc++ | 2 | 0 |
| 23 | AAG | TAAGCAGTACTGTAGGCCCT | 23621 | ScaCas9-Sc++ | 2 | 0 |
| 24 | AAG | TAAGCAGTACTGTAGGCCCT | 23622 | SpyCas9-SpRY | 2 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 25 | GG | TGATAATAACTTTTCACTTA | 23623 | SpyCas9-NG | 2 | 0 |
| 26 | GG | TGATAATAACTTTTCACTTA | 23624 | SpyCas9-xCas | 2 | 0 |
| 27 | GG | TGATAATAACTTTTCACTTA | 23625 | SpyCas9-xCas-NG | 2 | 0 |
| 28 | GGGCC | cagtGATAATAACTTTTCACTTA | 23626 | BlatCas9 | 2 | 0 |
| 29 | GGGC | TGATAATAACTTTTCACTTA | 23627 | SpyCas9-3var-NRRH | 2 | 0 |
| 30 | AAGT | TAAGCAGTACTGTAGGCCCT | 23628 | SpyCas9-3var-NRRH | 2 | 0 |
| 31 | aGGGCC | aaCAGTGATAATAACTTTTCACTT | 23629 | Nme2Cas9 | 3 | 1 |
| 32 | aGGG | AGTGATAATAACTTTTCACTT | 23630 | SauriCas9 | 3 | 1 |
| 33 | aGGG | AGTGATAATAACTTTTCACTT | 23631 | SauriCas9-KKH | 3 | 1 |
| 34 | tAAG | GATAAGCAGTACTGTAGGCCC | 23632 | SauriCas9-KKH | 3 | 1 |
| 35 | tAAG | ATAAGCAGTACTGTAGGCCC | 23633 | SpyCas9-QQR1 | 3 | 1 |
| 36 | tAAG | gaTAAGCAGTACTGTAGGCCC | 23634 | iSpyMacCas9 | 3 | 1 |
| 37 | aGG | GTGATAATAACTTTTCACTT | 23635 | ScaCas9 | 3 | 1 |
| 38 | aGG | GTGATAATAACTTTTCACTT | 23636 | ScaCas9-HiFi-Sc++ | 3 | 1 |
| 39 | aGG | GTGATAATAACTTTTCACTT | 23637 | ScaCas9-Sc++ | 3 | 1 |
| 40 | aGG | GTGATAATAACTTTTCACTT | 23638 | SpyCas9 | 3 | 1 |
| 41 | aGG | GTGATAATAACTTTTCACTT | 23639 | SpyCas9-HF1 | 3 | 1 |
| 42 | aGG | GTGATAATAACTTTTCACTT | 23640 | SpyCas9-SpG | 3 | 1 |
| 43 | aGG | GTGATAATAACTTTTCACTT | 23641 | SpyCas9-SpRY | 3 | 1 |
| 44 | aG | GTGATAATAACTTTTCACTT | 23642 | SpyCas9-NG | 3 | 1 |
| 45 | aG | GTGATAATAACTTTTCACTT | 23643 | SpyCas9-xCas | 3 | 1 |
| 46 | aG | GTGATAATAACTTTTCACTT | 23644 | SpyCas9-xCas-NG | 3 | 1 |
| 47 | tAA | ATAAGCAGTACTGTAGGCCC | 23645 | SpyCas9-SpRY | 3 | 1 |
| 48 | aGGGCCTA | acagTGATAATAACTTTTCACTT | 23646 | BlatCas9 | 3 | 1 |
| 49 | aGGGC | acagTGATAATAACTTTTCACTT | 23647 | BlatCas9 | 3 | 1 |
| 50 | tAAGTG | GATAAGCAGTACTGTAGGCCC | 23648 | cCas9-v16 | 3 | 1 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 51 | tAAGTG | GATAAGCAGTACTGTAGGCCC | 23649 | cCas9-v21 | 3 | 1 |
| 52 | TaGGG | aaCAGTGATAATAACTTTTCACT | 23650 | SauCas9 | 4 | 1 |
| 53 | TaGGG | CAGTGATAATAACTTTTCACT | 23651 | SauCas9KKH | 4 | 1 |
| 54 | CtAAG | TGATAAGCAGTACTGTAGGCC | 23652 | SauCas9KKH | 4 | 1 |
| 55 | CtAAGT | TGATAAGCAGTACTGTAGGCC | 23653 | SauCas9KKH | 4 | 1 |
| 56 | CtAAGT | TGATAAGCAGTACTGTAGGCC | 23654 | cCas9-v17 | 4 | 1 |
| 57 | CtAAGT | TGATAAGCAGTACTGTAGGCC | 23655 | cCas9-v42 | 4 | 1 |
| 58 | TaGG | CAGTGATAATAACTTTTCACT | 23656 | SauriCas9 | 4 | 1 |
| 59 | TaGG | CAGTGATAATAACTTTTCACT | 23657 | SauriCas9-KKH | 4 | 1 |
| 60 | TaG | AGTGATAATAACTTTTCACT | 23658 | ScaCas9 | 4 | 1 |
| 61 | TaG | AGTGATAATAACTTTTCACT | 23659 | ScaCas9-HiFi-Sc++ | 4 | 1 |
| 62 | TaG | AGTGATAATAACTTTTCACT | 23660 | ScaCas9-Sc++ | 4 | 1 |
| 63 | TaG | AGTGATAATAACTTTTCACT | 23661 | SpyCas9-SpRY | 4 | 1 |
| 64 | CtA | GATAAGCAGTACTGTAGGCC | 23662 | SpyCas9-SpRY | 4 | 1 |
| 65 | TaGGGC | CAGTGATAATAACTTTTCACT | 23663 | cCas9-v17 | 4 | 1 |
| 66 | TaGGGC | CAGTGATAATAACTTTTCACT | 23664 | cCas9-v42 | 4 | 1 |
| 67 | CCtAA | CTGATAAGCAGTACTGTAGGC | 23665 | SauCas9KKH | 5 | 1 |
| 68 | TTaGG | ACAGTGATAATAACTTTTCAC | 23666 | SauCas9KKH | 5 | 1 |
| 69 | TTaG | ACAGTGATAATAACTTTTCAC | 23667 | SauriCas9-KKH | 5 | 1 |
| 70 | CCt | TGATAAGCAGTACTGTAGGC | 23668 | SpyCas9-SpRY | 5 | 1 |
| 71 | TTa | CAGTGATAATAACTTTTCAC | 23669 | SpyCas9-SpRY | 5 | 1 |
| 72 | TTaGGG | ACAGTGATAATAACTTTTCAC | 23670 | cCas9-v17 | 5 | 1 |
| 73 | TTaGGG | ACAGTGATAATAACTTTTCAC | 23671 | cCas9-v42 | 5 | 1 |
| 74 | CTTaG | AACAGTGATAATAACTTTTCA | 23672 | SauCas9KKH | 6 | 1 |
| 75 | CCC | CTGATAAGCAGTACTGTAGG | 23673 | SpyCas9-SpRY | 6 | 0 |
| 76 | CTT | ACAGTGATAATAACTTTTCA | 23674 | SpyCas9-SpRY | 6 | 0 |
| 77 | GCC | TCTGATAAGCAGTACTGTAG | 23675 | SpyCas9-SpRY | 7 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 78 | ACT | AACAGTGATAATAACTTTTC | 23676 | SpyCas9-SpRY | 7 | 0 |
| 79 | GG | CTCTGATAAGCAGTACTGTA | 23677 | SpyCas9-NG | 8 | 0 |
| 80 | GG | CTCTGATAAGCAGTACTGTA | 23678 | SpyCas9-xCas | 8 | 0 |
| 81 | GG | CTCTGATAAGCAGTACTGTA | 23679 | SpyCas9-xCas-NG | 8 | 0 |
| 82 | GGC | CTCTGATAAGCAGTACTGTA | 23680 | SpyCas9-SpG | 8 | 0 |
| 83 | GGC | CTCTGATAAGCAGTACTGTA | 23681 | SpyCas9-SpRY | 8 | 0 |
| 84 | CAC | TAACAGTGATAATAACTTTT | 23682 | SpyCas9-SpRY | 8 | 0 |
| 85 | GGCCCtAA | cttcTCTGATAAGCAGTACTGTA | 23683 | BlatCas9 | 8 | 1 |
| 86 | GGCCCtAA | cttcTCTGATAAGCAGTACTGTA | 23684 | BlatCas9 | 8 | 1 |
| 87 | GGCCC | cttcTCTGATAAGCAGTACTGTA | 23685 | BlatCas9 | 8 | 0 |
| 88 | GGCC | CTCTGATAAGCAGTACTGTA | 23686 | SpyCas9-3var-NRCH | 8 | 0 |
| 89 | CACT | TAACAGTGATAATAACTTTT | 23687 | SpyCas9-3var-NRCH | 8 | 0 |
| 90 | AGGCCC | ggCTTCTCTGATAAGCAGTACTGT | 23688 | Nme2Cas9 | 9 | 0 |
| 91 | AGG | TCTCTGATAAGCAGTACTGT | 23689 | ScaCas9 | 9 | 0 |
| 92 | AGG | TCTCTGATAAGCAGTACTGT | 23690 | ScaCas9-HiFi-Sc++ | 9 | 0 |
| 93 | AGG | TCTCTGATAAGCAGTACTGT | 23691 | ScaCas9-Sc++ | 9 | 0 |
| 94 | AGG | TCTCTGATAAGCAGTACTGT | 23692 | SpyCas9 | 9 | 0 |
| 95 | AGG | TCTCTGATAAGCAGTACTGT | 23693 | SpyCas9-HF1 | 9 | 0 |
| 96 | AGG | TCTCTGATAAGCAGTACTGT | 23694 | SpyCas9-SpG | 9 | 0 |
| 97 | AGG | TCTCTGATAAGCAGTACTGT | 23695 | SpyCas9-SpRY | 9 | 0 |
| 98 | AG | TCTCTGATAAGCAGTACTGT | 23696 | SpyCas9-NG | 9 | 0 |
| 99 | AG | TCTCTGATAAGCAGTACTGT | 23697 | SpyCas9-xCas | 9 | 0 |
| 100 | AG | TCTCTGATAAGCAGTACTGT | 23698 | SpyCas9-xCas-NG | 9 | 0 |
| 101 | TCA | TTAACAGTGATAATAACTTT | 23699 | SpyCas9-SpRY | 9 | 0 |
| 102 | AGGCCCtA | gcttCTCTGATAAGCAGTACTGT | 23700 | BlatCas9 | 9 | 1 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 103 | AGGCC | gcttCTCTGATAAGCAGTACTGT | 23701 | BlatCas9 | 9 | 0 |
| 104 | AGGCCCt | CTTCTCTGATAAGCAGTACTGT | 23702 | CdiCas9 | 9 | 1 |
| 105 | AGGC | TCTCTGATAAGCAGTACTGT | 23703 | SpyCas9-3var-NRRH | 9 | 0 |
| 106 | TAGGCC | tgGCTTCTCTGATAAGCAGTACTG | 23704 | Nme2Cas9 | 10 | 0 |
| 107 | TAGG | CTTCTCTGATAAGCAGTACTG | 23705 | SauriCas9 | 10 | 0 |
| 108 | TAGG | CTTCTCTGATAAGCAGTACTG | 23706 | SauriCas9-KKH | 10 | 0 |
| 109 | TAG | TTCTCTGATAAGCAGTACTG | 23707 | ScaCas9 | 10 | 0 |
| 110 | TAG | TTCTCTGATAAGCAGTACTG | 23708 | ScaCas9-HiFi-Sc++ | 10 | 0 |
| 111 | TAG | TTCTCTGATAAGCAGTACTG | 23709 | ScaCas9-Sc++ | 10 | 0 |
| 112 | TAG | TTCTCTGATAAGCAGTACTG | 23710 | SpyCas9-SpRY | 10 | 0 |
| 113 | TTC | TTTAACAGTGATAATAACTT | 23711 | SpyCas9-SpRY | 10 | 0 |
| 114 | TTCACTTa | tgatTTAACAGTGATAATAACTT | 23712 | BlatCas9 | 10 | 1 |
| 115 | TAGGC | ggctTCTCTGATAAGCAGTACTG | 23713 | BlatCas9 | 10 | 0 |
| 116 | TTCAC | tgatTTAACAGTGATAATAACTT | 23714 | BlatCas9 | 10 | 0 |
| 117 | TTCACT | ATTTAACAGTGATAATAACTT | 23715 | cCas9-v16 | 10 | 0 |
| 118 | TTCACT | ATTTAACAGTGATAATAACTT | 23716 | cCas9-v21 | 10 | 0 |
| 119 | GTAGG | GCTTCTCTGATAAGCAGTACT | 23717 | SauCas9KKH | 11 | 0 |
| 120 | GTAG | GCTTCTCTGATAAGCAGTACT | 23718 | SauriCas9-KKH | 11 | 0 |
| 121 | GTA | CTTCTCTGATAAGCAGTACT | 23719 | SpyCas9-SpRY | 11 | 0 |
| 122 | TTT | ATTTAACAGTGATAATAACT | 23720 | SpyCas9-SpRY | 11 | 0 |
| 123 | GTAGGC | GCTTCTCTGATAAGCAGTACT | 23721 | cCas9-v17 | 11 | 0 |
| 124 | GTAGGC | GCTTCTCTGATAAGCAGTACT | 23722 | cCas9-v42 | 11 | 0 |
| 125 | TGTAG | GGCTTCTCTGATAAGCAGTAC | 23723 | SauCas9KKH | 12 | 0 |
| 126 | TG | GCTTCTCTGATAAGCAGTAC | 23724 | SpyCas9-NG | 12 | 0 |
| 127 | TG | GCTTCTCTGATAAGCAGTAC | 23725 | SpyCas9-xCas | 12 | 0 |
| 128 | TG | GCTTCTCTGATAAGCAGTAC | 23726 | SpyCas9-xCas-NG | 12 | 0 |
| 129 | TGT | GCTTCTCTGATAAGCAGTAC | 23727 | SpyCas9-SpG | 12 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 130 | TGT | GCTTCTCTGATAAGCAGTAC | 23728 | SpyCas9-SpRY | 12 | 0 |
| 131 | TTT | GATTTAACAGTGATAATAAC | 23729 | SpyCas9-SpRY | 12 | 0 |
| 132 | TTTTC | cctgATTTAACAGTGATAATAAC | 23730 | BlatCas9 | 12 | 0 |
| 133 | TGTA | GCTTCTCTGATAAGCAGTAC | 23731 | SpyCas9-3var-NRTH | 12 | 0 |
| 134 | CTG | GGCTTCTCTGATAAGCAGTA | 23732 | ScaCas9 | 13 | 0 |
| 135 | CTG | GGCTTCTCTGATAAGCAGTA | 23733 | ScaCas9-HiFi-Sc++ | 13 | 0 |
| 136 | CTG | GGCTTCTCTGATAAGCAGTA | 23734 | ScaCas9-Sc++ | 13 | 0 |
| 137 | CTG | GGCTTCTCTGATAAGCAGTA | 23735 | SpyCas9-SpRY | 13 | 0 |
| 138 | CTT | TGATTTAACAGTGATAATAA | 23736 | SpyCas9-SpRY | 13 | 0 |
| 139 | ACT | TGGCTTCTCTGATAAGCAGT | 23737 | SpyCas9-SpRY | 14 | 0 |
| 140 | ACT | CTGATTTAACAGTGATAATA | 23738 | SpyCas9-SpRY | 14 | 0 |
| 141 | TAC | TTGGCTTCTCTGATAAGCAG | 23739 | SpyCas9-SpRY | 15 | 0 |
| 142 | AAC | CCTGATTTAACAGTGATAAT | 23740 | SpyCas9-SpRY | 15 | 0 |
| 143 | TACT | TTGGCTTCTCTGATAAGCAG | 23741 | SpyCas9-3var-NRCH | 15 | 0 |
| 144 | AACT | CCTGATTTAACAGTGATAAT | 23742 | SpyCas9-3var-NRCH | 15 | 0 |
| 145 | TAA | TCCTGATTTAACAGTGATAA | 23743 | SpyCas9-SpRY | 16 | 0 |
| 146 | GTA | TTTGGCTTCTCTGATAAGCA | 23744 | SpyCas9-SpRY | 16 | 0 |
| 147 | TAACTTT | GATCCTGATTTAACAGTGATAA | 23745 | CdiCas9 | 16 | 0 |
| 148 | TAAC | TCCTGATTTAACAGTGATAA | 23746 | SpyCas9-3var-NRRH | 16 | 0 |
| 149 | TAAC | atCCTGATTTAACAGTGATAA | 23747 | iSpyMacCas9 | 16 | 0 |
| 150 | AG | CTTTGGCTTCTCTGATAAGC | 23748 | SpyCas9-NG | 17 | 0 |
| 151 | AG | CTTTGGCTTCTCTGATAAGC | 23749 | SpyCas9-xCas | 17 | 0 |
| 152 | AG | CTTTGGCTTCTCTGATAAGC | 23750 | SpyCas9-xCas-NG | 17 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 153 | AGT | CTTTGGCTTCTCTGATAAGC | 23751 | SpyCas9-SpG | 17 | 0 |
| 154 | AGT | CTTTGGCTTCTCTGATAAGC | 23752 | SpyCas9-SpRY | 17 | 0 |
| 155 | ATA | ATCCTGATTTAACAGTGATA | 23753 | SpyCas9-SpRY | 17 | 0 |
| 156 | AGTACTGT | aagcTTTGGCTTCTCTGATAAGC | 23754 | BlatCas9 | 17 | 0 |
| 157 | ATAACTTT | ctgaTCCTGATTTAACAGTGATA | 23755 | BlatCas9 | 17 | 0 |
| 158 | AGTAC | aagcTTTGGCTTCTCTGATAAGC | 23756 | BlatCas9 | 17 | 0 |
| 159 | ATAAC | ctgaTCCTGATTTAACAGTGATA | 23757 | BlatCas9 | 17 | 0 |
| 160 | ATAACT | GATCCTGATTTAACAGTGATA | 23758 | cCas9-v16 | 17 | 0 |
| 161 | ATAACT | GATCCTGATTTAACAGTGATA | 23759 | cCas9-v21 | 17 | 0 |
| 162 | ATAACTT | TGATCCTGATTTAACAGTGATA | 23760 | CdiCas9 | 17 | 0 |
| 163 | AGTA | CTTTGGCTTCTCTGATAAGC | 23761 | SpyCas9-3var-NRTH | 17 | 0 |
| 164 | AATAA | TGATCCTGATTTAACAGTGAT | 23762 | SauCas9KKH | 18 | 0 |
| 165 | CAG | GCTTTGGCTTCTCTGATAAG | 23763 | ScaCas9 | 18 | 0 |
| 166 | CAG | GCTTTGGCTTCTCTGATAAG | 23764 | ScaCas9-HiFi-Sc++ | 18 | 0 |
| 167 | CAG | GCTTTGGCTTCTCTGATAAG | 23765 | ScaCas9-Sc++ | 18 | 0 |
| 168 | CAG | GCTTTGGCTTCTCTGATAAG | 23766 | SpyCas9-SpRY | 18 | 0 |
| 169 | AAT | GATCCTGATTTAACAGTGAT | 23767 | SpyCas9-SpRY | 18 | 0 |
| 170 | CAGTACT | AAGCTTTGGCTTCTCTGATAAG | 23768 | CdiCas9 | 18 | 0 |
| 171 | CAGT | GCTTTGGCTTCTCTGATAAG | 23769 | SpyCas9-3var-NRRH | 18 | 0 |
| 172 | AATA | GATCCTGATTTAACAGTGAT | 23770 | SpyCas9-3var-NRTH | 18 | 0 |
| 173 | GCAG | AAGCTTTGGCTTCTCTGATAA | 23771 | SauriCas9-KKH | 19 | 0 |
| 174 | TAA | TGATCCTGATTTAACAGTGA | 23772 | SpyCas9-SpRY | 19 | 0 |
| 175 | GCA | AGCTTTGGCTTCTCTGATAA | 23773 | SpyCas9-SpRY | 19 | 0 |
| 176 | TAATAAC | ACTGATCCTGATTTAACAGTGA | 23774 | CdiCas9 | 19 | 0 |
| 177 | TAAT | TGATCCTGATTTAACAGTGA | 23775 | SpyCas9-3var-NRRH | 19 | 0 |
| 178 | TAAT | ctGATCCTGATTTAACAGTGA | 23776 | iSpyMacCas9 | 19 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 179 | AGCAG | GAAGCTTTGGCTTCTCTGATA | 23777 | SauCas9KKH | 20 | 0 |
| 180 | AGCAGT | GAAGCTTTGGCTTCTCTGATA | 23778 | SauCas9KKH | 20 | 0 |
| 181 | AGCAGT | GAAGCTTTGGCTTCTCTGATA | 23779 | cCas9-v17 | 20 | 0 |
| 182 | AGCAGT | GAAGCTTTGGCTTCTCTGATA | 23780 | cCas9-v42 | 20 | 0 |
| 183 | AG | AAGCTTTGGCTTCTCTGATA | 23781 | SpyCas9-NG | 20 | 0 |
| 184 | AG | AAGCTTTGGCTTCTCTGATA | 23782 | SpyCas9-xCas | 20 | 0 |
| 185 | AG | AAGCTTTGGCTTCTCTGATA | 23783 | SpyCas9-xCas-NG | 20 | 0 |
| 186 | AGC | AAGCTTTGGCTTCTCTGATA | 23784 | SpyCas9-SpG | 20 | 0 |
| 187 | AGC | AAGCTTTGGCTTCTCTGATA | 23785 | SpyCas9-SpRY | 20 | 0 |
| 188 | ATA | CTGATCCTGATTTAACAGTG | 23786 | SpyCas9-SpRY | 20 | 0 |
| 189 | AGCAGTAC | gaGAAGCTTTGGCTTCTCTGATA | 23787 | CjeCas9 | 20 | 0 |
| 190 | AGCA | AAGCTTTGGCTTCTCTGATA | 23788 | SpyCas9-3var-NRCH | 20 | 0 |
| 191 | GATAA | TACTGATCCTGATTTAACAGT | 23789 | SauCas9KKH | 21 | 0 |
| 192 | GATAAT | TACTGATCCTGATTTAACAGT | 23790 | SauCas9KKH | 21 | 0 |
| 193 | AAG | GAAGCTTTGGCTTCTCTGAT | 23791 | ScaCas9 | 21 | 0 |
| 194 | AAG | GAAGCTTTGGCTTCTCTGAT | 23792 | ScaCas9-HiFi-Sc++ | 21 | 0 |
| 195 | AAG | GAAGCTTTGGCTTCTCTGAT | 23793 | ScaCas9-Sc++ | 21 | 0 |
| 196 | AAG | GAAGCTTTGGCTTCTCTGAT | 23794 | SpyCas9-SpRY | 21 | 0 |
| 197 | GAT | ACTGATCCTGATTTAACAGT | 23795 | SpyCas9-SpRY | 21 | 0 |
| 198 | GAT | ACTGATCCTGATTTAACAGT | 23796 | SpyCas9-xCas | 21 | 0 |
| 199 | AAGC | GAAGCTTTGGCTTCTCTGAT | 23797 | SpyCas9-3var-NRRH | 21 | 0 |
| 200 | GATA | ACTGATCCTGATTTAACAGT | 23798 | SpyCas9-3var-NRTH | 21 | 0 |
| 201 | TAAG | GAGAAGCTTTGGCTTCTCTGA | 23799 | SauriCas9-KKH | 22 | 0 |
| 202 | TAAG | AGAAGCTTTGGCTTCTCTGA | 23800 | SpyCas9-QQR1 | 22 | 0 |
| 203 | TAAG | gaGAAGCTTTGGCTTCTCTGA | 23801 | iSpyMacCas9 | 22 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 204 | TG | TACTGATCCTGATTTAACAG | 23802 | SpyCas9-NG | 22 | 0 |
| 205 | TG | TACTGATCCTGATTTAACAG | 23803 | SpyCas9-xCas | 22 | 0 |
| 206 | TG | TACTGATCCTGATTTAACAG | 23804 | SpyCas9-xCas-NG | 22 | 0 |
| 207 | TAA | AGAAGCTTTGGCTTCTCTGA | 23805 | SpyCas9-SpRY | 22 | 0 |
| 208 | TGA | TACTGATCCTGATTTAACAG | 23806 | SpyCas9-SpG | 22 | 0 |
| 209 | TGA | TACTGATCCTGATTTAACAG | 23807 | SpyCas9-SpRY | 22 | 0 |
| 210 | TAAGCAGT | gggaGAAGCTTTGGCTTCTCTGA | 23808 | BlatCas9 | 22 | 0 |
| 211 | TAAGC | gggaGAAGCTTTGGCTTCTCTGA | 23809 | BlatCas9 | 22 | 0 |
| 212 | TGATAAT | AATACTGATCCTGATTTAACAG | 23810 | CdiCas9 | 22 | 0 |
| 213 | TGAT | TACTGATCCTGATTTAACAG | 23811 | SpyCas9-3var-NRRH | 22 | 0 |
| 214 | TGAT | TACTGATCCTGATTTAACAG | 23812 | SpyCas9-VQR | 22 | 0 |
| 215 | ATAAG | GGAGAAGCTTTGGCTTCTCTG | 23813 | SauCas9KKH | 23 | 0 |
| 216 | GTG | ATACTGATCCTGATTTAACA | 23814 | ScaCas9 | 23 | 0 |
| 217 | GTG | ATACTGATCCTGATTTAACA | 23815 | ScaCas9-HiFi-Sc++ | 23 | 0 |
| 218 | GTG | ATACTGATCCTGATTTAACA | 23816 | ScaCas9-Sc++ | 23 | 0 |
| 219 | GTG | ATACTGATCCTGATTTAACA | 23817 | SpyCas9-SpRY | 23 | 0 |
| 220 | ATA | GAGAAGCTTTGGCTTCTCTG | 23818 | SpyCas9-SpRY | 23 | 0 |
| 221 | ATAAGC | GGAGAAGCTTTGGCTTCTCTG | 23819 | cCas9-v17 | 23 | 0 |
| 222 | ATAAGC | GGAGAAGCTTTGGCTTCTCTG | 23820 | cCas9-v42 | 23 | 0 |
| 223 | GATAA | GGGAGAAGCTTTGGCTTCTCT | 23821 | SauCas9KKH | 24 | 0 |
| 224 | AGTGA | GAATACTGATCCTGATTTAAC | 23822 | SauCas9KKH | 24 | 0 |
| 225 | AGTGAT | GAATACTGATCCTGATTTAAC | 23823 | SauCas9KKH | 24 | 0 |
| 226 | AG | AATACTGATCCTGATTTAAC | 23824 | SpyCas9-NG | 24 | 0 |
| 227 | AG | AATACTGATCCTGATTTAAC | 23825 | SpyCas9-xCas | 24 | 0 |
| 228 | AG | AATACTGATCCTGATTTAAC | 23826 | SpyCas9-xCas-NG | 24 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 229 | GAT | GGAGAAGCTTTGGCTTCTCT | 23827 | SpyCas9-SpRY | 24 | 0 |
| 230 | GAT | GGAGAAGCTTTGGCTTCTCT | 23828 | SpyCas9-xCas | 24 | 0 |
| 231 | AGT | AATACTGATCCTGATTTAAC | 23829 | SpyCas9-SpG | 24 | 0 |
| 232 | AGT | AATACTGATCCTGATTTAAC | 23830 | SpyCas9-SpRY | 24 | 0 |
| 233 | GATA | GGAGAAGCTTTGGCTTCTCT | 23831 | SpyCas9-3var-NRTH | 24 | 0 |
| 234 | CAG | GAATACTGATCCTGATTTAA | 23832 | ScaCas9 | 25 | 0 |
| 235 | CAG | GAATACTGATCCTGATTTAA | 23833 | ScaCas9-HiFi-Sc++ | 25 | 0 |
| 236 | CAG | GAATACTGATCCTGATTTAA | 23834 | ScaCas9-Sc++ | 25 | 0 |
| 237 | CAG | GAATACTGATCCTGATTTAA | 23835 | SpyCas9-SpRY | 25 | 0 |
| 238 | TG | GGGAGAAGCTTTGGCTTCTC | 23836 | SpyCas9-NG | 25 | 0 |
| 239 | TG | GGGAGAAGCTTTGGCTTCTC | 23837 | SpyCas9-xCas | 25 | 0 |
| 240 | TG | GGGAGAAGCTTTGGCTTCTC | 23838 | SpyCas9-xCas-NG | 25 | 0 |
| 241 | TGA | GGGAGAAGCTTTGGCTTCTC | 23839 | SpyCas9-SpG | 25 | 0 |
| 242 | TGA | GGGAGAAGCTTTGGCTTCTC | 23840 | SpyCas9-SpRY | 25 | 0 |
| 243 | CAGTGATA | caggGAATACTGATCCTGATTTAA | 23841 | NmeCas9 | 25 | 0 |
| 244 | TGAT | GGGAGAAGCTTTGGCTTCTC | 23842 | SpyCas9-3var-NRRH | 25 | 0 |
| 245 | TGAT | GGGAGAAGCTTTGGCTTCTC | 23843 | SpyCas9-VQR | 25 | 0 |
| 246 | CAGT | GAATACTGATCCTGATTTAA | 23844 | SpyCas9-3var-NRRH | 25 | 0 |
| 247 | ACAG | GGGAATACTGATCCTGATTTA | 23845 | SauriCas9-KKH | 26 | 0 |
| 248 | CTG | GGGGAGAAGCTTTGGCTTCT | 23846 | ScaCas9 | 26 | 0 |
| 249 | CTG | GGGGAGAAGCTTTGGCTTCT | 23847 | ScaCas9-HiFi-Sc++ | 26 | 0 |
| 250 | CTG | GGGGAGAAGCTTTGGCTTCT | 23848 | ScaCas9-Sc++ | 26 | 0 |
| 251 | CTG | GGGGAGAAGCTTTGGCTTCT | 23849 | SpyCas9-SpRY | 26 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 252 | ACA | GGAATACTGATCCTGATTTA | 23850 | SpyCas9-SpRY | 26 | 0 |
| 253 | ACAGTG | GGGAATACTGATCCTGATTTA | 23851 | cCas9-v16 | 26 | 0 |
| 254 | ACAGTG | GGGAATACTGATCCTGATTTA | 23852 | cCas9-v21 | 26 | 0 |
| 255 | TCTGA | AGGGGGAGAAGCTTTGGCTTC | 23853 | SauCas9KKH | 27 | 0 |
| 256 | AACAG | AGGGAATACTGATCCTGATTT | 23854 | SauCas9KKH | 27 | 0 |
| 257 | TCTGAT | AGGGGGAGAAGCTTTGGCTTC | 23855 | SauCas9KKH | 27 | 0 |
| 258 | AACAGT | AGGGAATACTGATCCTGATTT | 23856 | SauCas9KKH | 27 | 0 |
| 259 | AACAGT | AGGGAATACTGATCCTGATTT | 23857 | cCas9-v17 | 27 | 0 |
| 260 | AACAGT | AGGGAATACTGATCCTGATTT | 23858 | cCas9-v42 | 27 | 0 |
| 261 | AAC | GGGAATACTGATCCTGATTT | 23859 | SpyCas9-SpRY | 27 | 0 |
| 262 | TCT | GGGGGAGAAGCTTTGGCTTC | 23860 | SpyCas9-SpRY | 27 | 0 |
| 263 | AACA | GGGAATACTGATCCTGATTT | 23861 | SpyCas9-3var-NRCH | 27 | 0 |
| 264 | TAA | AGGGAATACTGATCCTGATT | 23862 | SpyCas9-SpRY | 28 | 0 |
| 265 | CTC | AGGGGGAGAAGCTTTGGCTT | 23863 | SpyCas9-SpRY | 28 | 0 |
| 266 | TAAC | AGGGAATACTGATCCTGATT | 23864 | SpyCas9-3var-NRRH | 28 | 0 |
| 267 | TAAC | caGGGAATACTGATCCTGATT | 23865 | iSpyMacCas9 | 28 | 0 |
| 268 | CTCTGATA | ctccAGGGGGAGAAGCTTTGGCTT | 23866 | NmeCas9 | 28 | 0 |
| 269 | TCT | CAGGGGGAGAAGCTTTGGCT | 23867 | SpyCas9-SpRY | 29 | 0 |
| 270 | TTA | CAGGGAATACTGATCCTGAT | 23868 | SpyCas9-SpRY | 29 | 0 |
| 271 | TTAACAGT | cagcAGGGAATACTGATCCTGAT | 23869 | BlatCas9 | 29 | 0 |
| 272 | TTAAC | cagcAGGGAATACTGATCCTGAT | 23870 | BlatCas9 | 29 | 0 |
| 273 | TTTAA | AGCAGGGAATACTGATCCTGA | 23871 | SauCas9KKH | 30 | 0 |
| 274 | TTC | CCAGGGGGAGAAGCTTTGGC | 23872 | SpyCas9-SpRY | 30 | 0 |
| 275 | TTT | GCAGGGAATACTGATCCTGA | 23873 | SpyCas9-SpRY | 30 | 0 |
| 276 | TTCTCTGA | gctcCAGGGGGAGAAGCTTTGGC | 23874 | BlatCas9 | 30 | 0 |
| 277 | TTCTC | gctcCAGGGGGAGAAGCTTTGGC | 23875 | BlatCas9 | 30 | 0 |
| 278 | CTT | TCCAGGGGGAGAAGCTTTGG | 23876 | SpyCas9-SpRY | 31 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 279 | ATT | AGCAGGGAATACTGATCCTG | 23877 | SpyCas9-SpRY | 31 | 0 |
| 280 | GAT | CAGCAGGGAATACTGATCCT | 23878 | SpyCas9-SpRY | 32 | 0 |
| 281 | GAT | CAGCAGGGAATACTGATCCT | 23879 | SpyCas9-xCas | 32 | 0 |
| 282 | GCT | CTCCAGGGGGAGAAGCTTTG | 23880 | SpyCas9-SpRY | 32 | 0 |
| 283 | GCTTC | cagcTCCAGGGGGAGAAGCTTTG | 23881 | BlatCas9 | 32 | 0 |
| 284 | GATT | CAGCAGGGAATACTGATCCT | 23882 | SpyCas9-3var-NRTH | 32 | 0 |
| 285 | GG | GCTCCAGGGGGAGAAGCTTT | 23883 | SpyCas9-NG | 33 | 0 |
| 286 | GG | GCTCCAGGGGGAGAAGCTTT | 23884 | SpyCas9-xCas | 33 | 0 |
| 287 | GG | GCTCCAGGGGGAGAAGCTTT | 23885 | SpyCas9-xCas-NG | 33 | 0 |
| 288 | TG | GCAGCAGGGAATACTGATCC | 23886 | SpyCas9-NG | 33 | 0 |
| 289 | TG | GCAGCAGGGAATACTGATCC | 23887 | SpyCas9-xCas | 33 | 0 |
| 290 | TG | GCAGCAGGGAATACTGATCC | 23888 | SpyCas9-xCas-NG | 33 | 0 |
| 291 | GGC | GCTCCAGGGGGAGAAGCTTT | 23889 | SpyCas9-SpG | 33 | 0 |
| 292 | GGC | GCTCCAGGGGGAGAAGCTTT | 23890 | SpyCas9-SpRY | 33 | 0 |
| 293 | TGA | GCAGCAGGGAATACTGATCC | 23891 | SpyCas9-SpG | 33 | 0 |
| 294 | TGA | GCAGCAGGGAATACTGATCC | 23892 | SpyCas9-SpRY | 33 | 0 |
| 295 | TGAT | GCAGCAGGGAATACTGATCC | 23893 | SpyCas9-3var-NRRH | 33 | 0 |
| 296 | TGAT | GCAGCAGGGAATACTGATCC | 23894 | SpyCas9-VQR | 33 | 0 |
| 297 | GGCT | GCTCCAGGGGGAGAAGCTTT | 23895 | SpyCas9-3var-NRCH | 33 | 0 |
| 298 | TGG | AGCTCCAGGGGGAGAAGCTT | 23896 | ScaCas9 | 34 | 0 |
| 299 | TGG | AGCTCCAGGGGGAGAAGCTT | 23897 | ScaCas9-HiFi-Sc++ | 34 | 0 |
| 300 | TGG | AGCTCCAGGGGGAGAAGCTT | 23898 | ScaCas9-Sc++ | 34 | 0 |
| 301 | TGG | AGCTCCAGGGGGAGAAGCTT | 23899 | SpyCas9 | 34 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 302 | TGG | AGCTCCAGGGGGAGAAGCTT | 23900 | SpyCas9-HF1 | 34 | 0 |
| 303 | TGG | AGCTCCAGGGGGAGAAGCTT | 23901 | SpyCas9-SpG | 34 | 0 |
| 304 | TGG | AGCTCCAGGGGGAGAAGCTT | 23902 | SpyCas9-SpRY | 34 | 0 |
| 305 | CTG | TGCAGCAGGGAATACTGATC | 23903 | ScaCas9 | 34 | 0 |
| 306 | CTG | TGCAGCAGGGAATACTGATC | 23904 | ScaCas9-HiFi-Sc++ | 34 | 0 |
| 307 | CTG | TGCAGCAGGGAATACTGATC | 23905 | ScaCas9-Sc++ | 34 | 0 |
| 308 | CTG | TGCAGCAGGGAATACTGATC | 23906 | SpyCas9-SpRY | 34 | 0 |
| 309 | TG | AGCTCCAGGGGGAGAAGCTT | 23907 | SpyCas9-NG | 34 | 0 |
| 310 | TG | AGCTCCAGGGGGAGAAGCTT | 23908 | SpyCas9-xCas | 34 | 0 |
| 311 | TG | AGCTCCAGGGGGAGAAGCTT | 23909 | SpyCas9-xCas-NG | 34 | 0 |
| 312 | CTGATT | ATGCAGCAGGGAATACTGATC | 23910 | cCas9-v16 | 34 | 0 |
| 313 | CTGATT | ATGCAGCAGGGAATACTGATC | 23911 | cCas9-v21 | 34 | 0 |
| 314 | TGGCTTC | CCAGCTCCAGGGGGAGAAGCTT | 23912 | CdiCas9 | 34 | 0 |
| 315 | CTGATTT | GATGCAGCAGGGAATACTGATC | 23913 | CdiCas9 | 34 | 0 |
| 316 | TGGC | AGCTCCAGGGGGAGAAGCTT | 23914 | SpyCas9-3var-NRRH | 34 | 0 |
| 317 | CCTGATT | tggGATGCAGCAGGGAATACTGAT | 23915 | PpnCas9 | 35 | 0 |
| 318 | CCTGA | GATGCAGCAGGGAATACTGAT | 23916 | SauCas9KKH | 35 | 0 |
| 319 | CCTGAT | GATGCAGCAGGGAATACTGAT | 23917 | SauCas9KKH | 35 | 0 |
| 320 | TTGG | CCAGCTCCAGGGGGAGAAGCT | 23918 | SauriCas9 | 35 | 0 |
| 321 | TTGG | CCAGCTCCAGGGGGAGAAGCT | 23919 | SauriCas9-KKH | 35 | 0 |
| 322 | TTG | CAGCTCCAGGGGGAGAAGCT | 23920 | ScaCas9 | 35 | 0 |
| 323 | TTG | CAGCTCCAGGGGGAGAAGCT | 23921 | ScaCas9-HiFi-Sc++ | 35 | 0 |
| 324 | TTG | CAGCTCCAGGGGGAGAAGCT | 23922 | ScaCas9-Sc++ | 35 | 0 |
| 325 | TTG | CAGCTCCAGGGGGAGAAGCT | 23923 | SpyCas9-SpRY | 35 | 0 |
| 326 | CCT | ATGCAGCAGGGAATACTGAT | 23924 | SpyCas9-SpRY | 35 | 0 |
| 327 | TTGGC | ctccAGCTCCAGGGGGAGAAGCT | 23925 | BlatCas9 | 35 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 328 | TTGGCT | CCAGCTCCAGGGGGAGAAGCT | 23926 | cCas9-v16 | 35 | 0 |
| 329 | TTGGCT | CCAGCTCCAGGGGGAGAAGCT | 23927 | cCas9-v21 | 35 | 0 |
| 330 | TTTGG | TCCAGCTCCAGGGGGAGAAGC | 23928 | SauCas9KKH | 36 | 0 |
| 331 | TTT | CCAGCTCCAGGGGGAGAAGC | 23929 | SpyCas9-SpRY | 36 | 0 |
| 332 | TCC | GATGCAGCAGGGAATACTGA | 23930 | SpyCas9-SpRY | 36 | 0 |
| 333 | TCCTGATT | atggGATGCAGCAGGGAATACTGA | 23931 | NmeCas9 | 36 | 0 |
| 334 | TTTGGCTT | ttctCCAGCTCCAGGGGGAGAAGC | 23932 | NmeCas9 | 36 | 0 |
| 335 | CTT | TCCAGCTCCAGGGGGAGAAG | 23933 | SpyCas9-SpRY | 37 | 0 |
| 336 | ATC | GGATGCAGCAGGGAATACTG | 23934 | SpyCas9-SpRY | 37 | 0 |
| 337 | GAT | GGGATGCAGCAGGGAATACT | 23935 | SpyCas9-SpRY | 38 | 0 |
| 338 | GAT | GGGATGCAGCAGGGAATACT | 23936 | SpyCas9-xCas | 38 | 0 |
| 339 | GCT | CTCCAGCTCCAGGGGGAGAA | 23937 | SpyCas9-SpRY | 38 | 0 |
| 340 | GATCCTGA | tatgGGATGCAGCAGGGAATACT | 23938 | BlatCas9 | 38 | 0 |
| 341 | GATCC | tatgGGATGCAGCAGGGAATACT | 23939 | BlatCas9 | 38 | 0 |
| 342 | GATC | GGGATGCAGCAGGGAATACT | 23940 | SpyCas9-3var-NRTH | 38 | 0 |
| 343 | TGATCC | ccTATGGGATGCAGCAGGGAATAC | 23941 | Nme2Cas9 | 39 | 0 |
| 344 | AG | TCTCCAGCTCCAGGGGGAGA | 23942 | SpyCas9-NG | 39 | 0 |
| 345 | AG | TCTCCAGCTCCAGGGGGAGA | 23943 | SpyCas9-xCas | 39 | 0 |
| 346 | AG | TCTCCAGCTCCAGGGGGAGA | 23944 | SpyCas9-xCas-NG | 39 | 0 |
| 347 | TG | TGGGATGCAGCAGGGAATAC | 23945 | SpyCas9-NG | 39 | 0 |
| 348 | TG | TGGGATGCAGCAGGGAATAC | 23946 | SpyCas9-xCas | 39 | 0 |
| 349 | TG | TGGGATGCAGCAGGGAATAC | 23947 | SpyCas9-xCas-NG | 39 | 0 |
| 350 | AGC | TCTCCAGCTCCAGGGGGAGA | 23948 | SpyCas9-SpG | 39 | 0 |
| 351 | AGC | TCTCCAGCTCCAGGGGGAGA | 23949 | SpyCas9-SpRY | 39 | 0 |

TABLE 1D-continued

Exemplary gRNA spacer Cas pairs for correcting the pathogenic IVS10-11G > A mutation Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 352 | TGA | TGGGATGCAGCAGGGAATAC | 23950 | SpyCas9-SpG | 39 | 0 |
| 353 | TGA | TGGGATGCAGCAGGGAATAC | 23951 | SpyCas9-SpRY | 39 | 0 |
| 354 | TGATCCTG | ctatGGGATGCAGCAGGGAATAC | 23952 | BlatCas9 | 39 | 0 |
| 355 | TGATC | ctatGGGATGCAGCAGGGAATAC | 23953 | BlatCas9 | 39 | 0 |
| 356 | TGATCCT | TATGGGATGCAGCAGGGAATAC | 23954 | CdiCas9 | 39 | 0 |
| 357 | TGAT | TGGGATGCAGCAGGGAATAC | 23955 | SpyCas9-3var-NRRH | 39 | 0 |
| 358 | TGAT | TGGGATGCAGCAGGGAATAC | 23956 | SpyCas9-VQR | 39 | 0 |
| 359 | AGCT | TCTCCAGCTCCAGGGGGAGA | 23957 | SpyCas9-3var-NRCH | 39 | 0 |
| 360 | AAG | TTCTCCAGCTCCAGGGGGAG | 23958 | ScaCas9 | 40 | 0 |
| 361 | AAG | TTCTCCAGCTCCAGGGGGAG | 23959 | ScaCas9-HiFi-Sc++ | 40 | 0 |
| 362 | AAG | TTCTCCAGCTCCAGGGGGAG | 23960 | ScaCas9-Sc++ | 40 | 0 |
| 363 | AAG | TTCTCCAGCTCCAGGGGGAG | 23961 | SpyCas9-SpRY | 40 | 0 |
| 364 | CTG | ATGGGATGCAGCAGGGAATA | 23962 | ScaCas9 | 40 | 0 |
| 365 | CTG | ATGGGATGCAGCAGGGAATA | 23963 | ScaCas9-HiFi-Sc++ | 40 | 0 |
| 366 | CTG | ATGGGATGCAGCAGGGAATA | 23964 | ScaCas9-Sc++ | 40 | 0 |
| 367 | CTG | ATGGGATGCAGCAGGGAATA | 23965 | SpyCas9-SpRY | 40 | 0 |
| 368 | AAGCTTT | TCTTCTCCAGCTCCAGGGGGAG | 23966 | CdiCas9 | 40 | 0 |
| 369 | CTGATCC | CTATGGGATGCAGCAGGGAATA | 23967 | CdiCas9 | 40 | 0 |
| 370 | AAGC | TTCTCCAGCTCCAGGGGGAG | 23968 | SpyCas9-3var-NRRH | 40 | 0 |
| 371 | ACTGA | CTATGGGATGCAGCAGGGAAT | 23969 | SauCas9KKH | 41 | 0 |
| 372 | ACTGAT | CTATGGGATGCAGCAGGGAAT | 23970 | SauCas9KKH | 41 | 0 |
| 373 | GAAG | TCTTCTCCAGCTCCAGGGGGA | 23971 | SauriCas9-KKH | 41 | 0 |
| 374 | GAAG | CTTCTCCAGCTCCAGGGGGA | 23972 | SpyCas9-QQR1 | 41 | 0 |
| 375 | GAAG | tcTTCTCCAGCTCCAGGGGGA | 23973 | iSpyMacCas9 | 41 | 0 |
| 376 | GAA | CTTCTCCAGCTCCAGGGGGA | 23974 | SpyCas9-SpRY | 41 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 377 | GAA | CTTCTCCAGCTCCAGGGGGA | 23975 | SpyCas9-xCas | 41 | 0 |
| 378 | ACT | TATGGGATGCAGCAGGGAAT | 23976 | SpyCas9-SpRY | 41 | 0 |
| 379 | GAAGCTTT | tgtcTTCTCCAGCTCCAGGGGGA | 23977 | BlatCas9 | 41 | 0 |
| 380 | GAAGC | tgtcTTCTCCAGCTCCAGGGGGA | 23978 | BlatCas9 | 41 | 0 |
| 381 | GAAGCT | TCTTCTCCAGCTCCAGGGGGA | 23979 | cCas9-v16 | 41 | 0 |
| 382 | GAAGCT | TCTTCTCCAGCTCCAGGGGGA | 23980 | cCas9-v21 | 41 | 0 |
| 383 | AGAAG | GTCTTCTCCAGCTCCAGGGGG | 23981 | SauCas9KKH | 42 | 0 |
| 384 | AG | TCTTCTCCAGCTCCAGGGGG | 23982 | SpyCas9-NG | 42 | 0 |
| 385 | AG | TCTTCTCCAGCTCCAGGGGG | 23983 | SpyCas9-xCas | 42 | 0 |
| 386 | AG | TCTTCTCCAGCTCCAGGGGG | 23984 | SpyCas9-xCas-NG | 42 | 0 |
| 387 | AGA | TCTTCTCCAGCTCCAGGGGG | 23985 | SpyCas9-SpG | 42 | 0 |
| 388 | AGA | TCTTCTCCAGCTCCAGGGGG | 23986 | SpyCas9-SpRY | 42 | 0 |
| 389 | TAC | CTATGGGATGCAGCAGGGAA | 23987 | SpyCas9-SpRY | 42 | 0 |
| 390 | AGAAGC | GTCTTCTCCAGCTCCAGGGGG | 23988 | cCas9-v17 | 42 | 0 |
| 391 | AGAAGC | GTCTTCTCCAGCTCCAGGGGG | 23989 | cCas9-v42 | 42 | 0 |
| 392 | AGAAGCTT | gctgTCTTCTCCAGCTCCAGGGGG | 23990 | NmeCas9 | 42 | 0 |
| 393 | AGAA | TCTTCTCCAGCTCCAGGGGG | 23991 | SpyCas9-3var-NRRH | 42 | 0 |
| 394 | AGAA | TCTTCTCCAGCTCCAGGGGG | 23992 | SpyCas9-VQR | 42 | 0 |
| 395 | TACT | CTATGGGATGCAGCAGGGAA | 23993 | SpyCas9-3var-NRCH | 42 | 0 |
| 396 | GAGAA | gcTGTCTTCTCCAGCTCCAGGGG | 23994 | SauCas9 | 43 | 0 |
| 397 | GAGAA | TGTCTTCTCCAGCTCCAGGGG | 23995 | SauCas9KKH | 43 | 0 |
| 398 | GAG | GTCTTCTCCAGCTCCAGGGG | 23996 | ScaCas9 | 43 | 0 |
| 399 | GAG | GTCTTCTCCAGCTCCAGGGG | 23997 | ScaCas9-HiFi-Sc++ | 43 | 0 |
| 400 | GAG | GTCTTCTCCAGCTCCAGGGG | 23998 | ScaCas9-Sc++ | 43 | 0 |
| 401 | GAG | GTCTTCTCCAGCTCCAGGGG | 23999 | SpyCas9-SpRY | 43 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 402 | ATA | CCTATGGGATGCAGCAGGGA | 24000 | SpyCas9-SpRY | 43 | 0 |
| 403 | GAGAAG | TGTCTTCTCCAGCTCCAGGGG | 24001 | cCas9-v17 | 43 | 0 |
| 404 | GAGAAG | TGTCTTCTCCAGCTCCAGGGG | 24002 | cCas9-v42 | 43 | 0 |
| 405 | GAGA | GTCTTCTCCAGCTCCAGGGG | 24003 | SpyCas9-3var-NRRH | 43 | 0 |
| 406 | GGAGA | CTGTCTTCTCCAGCTCCAGGG | 24004 | SauCas9KKH | 44 | 0 |
| 407 | GGAG | CTGTCTTCTCCAGCTCCAGGG | 24005 | SauriCas9-KKH | 44 | 0 |
| 408 | GGAG | TGTCTTCTCCAGCTCCAGGG | 24006 | SpyCas9-VQR | 44 | 0 |
| 409 | GG | TGTCTTCTCCAGCTCCAGGG | 24007 | SpyCas9-NG | 44 | 0 |
| 410 | GG | TGTCTTCTCCAGCTCCAGGG | 24008 | SpyCas9-xCas | 44 | 0 |
| 411 | GG | TGTCTTCTCCAGCTCCAGGG | 24009 | SpyCas9-xCas-NG | 44 | 0 |
| 412 | GGA | TGTCTTCTCCAGCTCCAGGG | 24010 | SpyCas9-SpG | 44 | 0 |
| 413 | GGA | TGTCTTCTCCAGCTCCAGGG | 24011 | SpyCas9-SpRY | 44 | 0 |
| 414 | AAT | GCCTATGGGATGCAGCAGGG | 24012 | SpyCas9-SpRY | 44 | 0 |
| 415 | AATACTGA | atggCCTATGGGATGCAGCAGGG | 24013 | BlatCas9 | 44 | 0 |
| 416 | AATAC | atggCCTATGGGATGCAGCAGGG | 24014 | BlatCas9 | 44 | 0 |
| 417 | GGAGAA | CTGTCTTCTCCAGCTCCAGGG | 24015 | cCas9-v17 | 44 | 0 |
| 418 | GGAGAA | CTGTCTTCTCCAGCTCCAGGG | 24016 | cCas9-v42 | 44 | 0 |
| 419 | AATA | GCCTATGGGATGCAGCAGGG | 24017 | SpyCas9-3var-NRTH | 44 | 0 |
| 420 | GGGAG | tgGCTGTCTTCTCCAGCTCCAGG | 24018 | SauCas9 | 45 | 0 |
| 421 | GGGAG | GCTGTCTTCTCCAGCTCCAGG | 24019 | SauCas9KKH | 45 | 0 |
| 422 | GGG | CTGTCTTCTCCAGCTCCAGG | 24020 | ScaCas9 | 45 | 0 |
| 423 | GGG | CTGTCTTCTCCAGCTCCAGG | 24021 | ScaCas9-HiFi-Sc++ | 45 | 0 |
| 424 | GGG | CTGTCTTCTCCAGCTCCAGG | 24022 | ScaCas9-Sc++ | 45 | 0 |
| 425 | GGG | CTGTCTTCTCCAGCTCCAGG | 24023 | SpyCas9 | 45 | 0 |
| 426 | GGG | CTGTCTTCTCCAGCTCCAGG | 24024 | SpyCas9-HF1 | 45 | 0 |
| 427 | GGG | CTGTCTTCTCCAGCTCCAGG | 24025 | SpyCas9-SpG | 45 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 428 | GGG | CTGTCTTCTCCAGCTCCAGG | 24026 | SpyCas9-SpRY | 45 | 0 |
| 429 | GG | CTGTCTTCTCCAGCTCCAGG | 24027 | SpyCas9-NG | 45 | 0 |
| 430 | GG | CTGTCTTCTCCAGCTCCAGG | 24028 | SpyCas9-xCas | 45 | 0 |
| 431 | GG | CTGTCTTCTCCAGCTCCAGG | 24029 | SpyCas9-xCas-NG | 45 | 0 |
| 432 | GAA | GGCCTATGGGATGCAGCAGG | 24030 | SpyCas9-SpRY | 45 | 0 |
| 433 | GAA | GGCCTATGGGATGCAGCAGG | 24031 | SpyCas9-xCas | 45 | 0 |
| 434 | GGGAGA | GCTGTCTTCTCCAGCTCCAGG | 24032 | cCas9-v17 | 45 | 0 |
| 435 | GGGAGA | GCTGTCTTCTCCAGCTCCAGG | 24033 | cCas9-v42 | 45 | 0 |
| 436 | GAATACT | ATGGCCTATGGGATGCAGCAGG | 24034 | CdiCas9 | 45 | 0 |
| 437 | GAAT | GGCCTATGGGATGCAGCAGG | 24035 | SpyCas9-3var-NRRH | 45 | 0 |
| 438 | GAAT | tgGCCTATGGGATGCAGCAGG | 24036 | iSpyMacCas9 | 45 | 0 |
| 439 | GGGA | CTGTCTTCTCCAGCTCCAGG | 24037 | SpyCas9-3var-NRRH | 45 | 0 |
| 440 | GGGGA | atGGCTGTCTTCTCCAGCTCCAG | 24038 | SauCas9 | 46 | 0 |
| 441 | GGGGA | GGCTGTCTTCTCCAGCTCCAG | 24039 | SauCas9KKH | 46 | 0 |
| 442 | GGGG | GGCTGTCTTCTCCAGCTCCAG | 24040 | SauriCas9 | 46 | 0 |
| 443 | GGGG | GGCTGTCTTCTCCAGCTCCAG | 24041 | SauriCas9-KKH | 46 | 0 |
| 444 | GGG | GCTGTCTTCTCCAGCTCCAG | 24042 | ScaCas9 | 46 | 0 |
| 445 | GGG | GCTGTCTTCTCCAGCTCCAG | 24043 | ScaCas9-HiFi-Sc++ | 46 | 0 |
| 446 | GGG | GCTGTCTTCTCCAGCTCCAG | 24044 | ScaCas9-Sc++ | 46 | 0 |
| 447 | GGG | GCTGTCTTCTCCAGCTCCAG | 24045 | SpyCas9 | 46 | 0 |
| 448 | GGG | GCTGTCTTCTCCAGCTCCAG | 24046 | SpyCas9-HF1 | 46 | 0 |
| 449 | GGG | GCTGTCTTCTCCAGCTCCAG | 24047 | SpyCas9-SpG | 46 | 0 |
| 450 | GGG | GCTGTCTTCTCCAGCTCCAG | 24048 | SpyCas9-SpRY | 46 | 0 |
| 451 | GG | GCTGTCTTCTCCAGCTCCAG | 24049 | SpyCas9-NG | 46 | 0 |
| 452 | GG | GCTGTCTTCTCCAGCTCCAG | 24050 | SpyCas9-xCas | 46 | 0 |
| 453 | GG | GCTGTCTTCTCCAGCTCCAG | 24051 | SpyCas9-xCas-NG | 46 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 454 | GG | TGGCCTATGGGATGCAGCAG | 24052 | SpyCas9-NG | 46 | 0 |
| 455 | GG | TGGCCTATGGGATGCAGCAG | 24053 | SpyCas9-xCas | 46 | 0 |
| 456 | GG | TGGCCTATGGGATGCAGCAG | 24054 | SpyCas9-xCas-NG | 46 | 0 |
| 457 | GGA | TGGCCTATGGGATGCAGCAG | 24055 | SpyCas9-SpG | 46 | 0 |
| 458 | GGA | TGGCCTATGGGATGCAGCAG | 24056 | SpyCas9-SpRY | 46 | 0 |
| 459 | GGGGAG | GGCTGTCTTCTCCAGCTCCAG | 24057 | cCas9-v17 | 46 | 0 |
| 460 | GGGGAG | GGCTGTCTTCTCCAGCTCCAG | 24058 | cCas9-v42 | 46 | 0 |
| 461 | GGAATAC | AATGGCCTATGGGATGCAGCAG | 24059 | CdiCas9 | 46 | 0 |
| 462 | GGAA | TGGCCTATGGGATGCAGCAG | 24060 | SpyCas9-3var-NRRH | 46 | 0 |
| 463 | GGAA | TGGCCTATGGGATGCAGCAG | 24061 | SpyCas9-VQR | 46 | 0 |
| 464 | GGGGG | gaTGGCTGTCTTCTCCAGCTCCA | 24062 | SauCas9 | 47 | 0 |
| 465 | GGGGG | TGGCTGTCTTCTCCAGCTCCA | 24063 | SauCas9KKH | 47 | 0 |
| 466 | GGGAA | caAATGGCCTATGGGATGCAGCA | 24064 | SauCas9 | 47 | 0 |
| 467 | GGGAA | AATGGCCTATGGGATGCAGCA | 24065 | SauCas9KKH | 47 | 0 |
| 468 | GGGAAT | caAATGGCCTATGGGATGCAGCA | 24066 | SauCas9 | 47 | 0 |
| 469 | GGGAAT | AATGGCCTATGGGATGCAGCA | 24067 | SauCas9KKH | 47 | 0 |
| 470 | GGGAAT | AATGGCCTATGGGATGCAGCA | 24068 | cCas9-v17 | 47 | 0 |
| 471 | GGGAAT | AATGGCCTATGGGATGCAGCA | 24069 | cCas9-v42 | 47 | 0 |
| 472 | GGGG | TGGCTGTCTTCTCCAGCTCCA | 24070 | SauriCas9 | 47 | 0 |
| 473 | GGGG | TGGCTGTCTTCTCCAGCTCCA | 24071 | SauriCas9-KKH | 47 | 0 |
| 474 | GGG | GGCTGTCTTCTCCAGCTCCA | 24072 | ScaCas9 | 47 | 0 |
| 475 | GGG | GGCTGTCTTCTCCAGCTCCA | 24073 | ScaCas9-HiFi-Sc++ | 47 | 0 |
| 476 | GGG | GGCTGTCTTCTCCAGCTCCA | 24074 | ScaCas9-Sc++ | 47 | 0 |
| 477 | GGG | GGCTGTCTTCTCCAGCTCCA | 24075 | SpyCas9 | 47 | 0 |
| 478 | GGG | GGCTGTCTTCTCCAGCTCCA | 24076 | SpyCas9-HF1 | 47 | 0 |
| 479 | GGG | GGCTGTCTTCTCCAGCTCCA | 24077 | SpyCas9-SpG | 47 | 0 |
| 480 | GGG | GGCTGTCTTCTCCAGCTCCA | 24078 | SpyCas9-SpRY | 47 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 481 | GGG | ATGGCCTATGGGATGCAGCA | 24079 | ScaCas9 | 47 | 0 |
| 482 | GGG | ATGGCCTATGGGATGCAGCA | 24080 | ScaCas9-HiFi-Sc++ | 47 | 0 |
| 483 | GGG | ATGGCCTATGGGATGCAGCA | 24081 | ScaCas9-Sc++ | 47 | 0 |
| 484 | GGG | ATGGCCTATGGGATGCAGCA | 24082 | SpyCas9 | 47 | 0 |
| 485 | GGG | ATGGCCTATGGGATGCAGCA | 24083 | SpyCas9-HF1 | 47 | 0 |
| 486 | GGG | ATGGCCTATGGGATGCAGCA | 24084 | SpyCas9-SpG | 47 | 0 |
| 487 | GGG | ATGGCCTATGGGATGCAGCA | 24085 | SpyCas9-SpRY | 47 | 0 |
| 488 | GG | GGCTGTCTTCTCCAGCTCCA | 24086 | SpyCas9-NG | 47 | 0 |
| 489 | GG | GGCTGTCTTCTCCAGCTCCA | 24087 | SpyCas9-xCas | 47 | 0 |
| 490 | GG | GGCTGTCTTCTCCAGCTCCA | 24088 | SpyCas9-xCas-NG | 47 | 0 |
| 491 | GG | ATGGCCTATGGGATGCAGCA | 24089 | SpyCas9-NG | 47 | 0 |
| 492 | GG | ATGGCCTATGGGATGCAGCA | 24090 | SpyCas9-xCas | 47 | 0 |
| 493 | GG | ATGGCCTATGGGATGCAGCA | 24091 | SpyCas9-xCas-NG | 47 | 0 |
| 494 | GGGGGA | TGGCTGTCTTCTCCAGCTCCA | 24092 | cCas9-v17 | 47 | 0 |
| 495 | GGGGGA | TGGCTGTCTTCTCCAGCTCCA | 24093 | cCas9-v42 | 47 | 0 |
| 496 | GGGAATAC | caAATGGCCTATGGGATGCAGCA | 24094 | CjeCas9 | 47 | 0 |
| 497 | GGGA | ATGGCCTATGGGATGCAGCA | 24095 | SpyCas9-3var-NRRH | 47 | 0 |
| 498 | AGGGG | ggATGGCTGTCTTCTCCAGCTCC | 24096 | SauCas9 | 48 | 0 |
| 499 | AGGGG | ATGGCTGTCTTCTCCAGCTCC | 24097 | SauCas9KKH | 48 | 0 |
| 500 | AGGGA | acAAATGGCCTATGGGATGCAGC | 24098 | SauCas9 | 48 | 0 |
| 501 | AGGGA | AAATGGCCTATGGGATGCAGC | 24099 | SauCas9KKH | 48 | 0 |
| 502 | AGGG | ATGGCTGTCTTCTCCAGCTCC | 24100 | SauriCas9 | 48 | 0 |
| 503 | AGGG | ATGGCTGTCTTCTCCAGCTCC | 24101 | SauriCas9-KKH | 48 | 0 |
| 504 | AGGG | AAATGGCCTATGGGATGCAGC | 24102 | SauriCas9 | 48 | 0 |
| 505 | AGGG | AAATGGCCTATGGGATGCAGC | 24103 | SauriCas9-KKH | 48 | 0 |
| 506 | AGG | TGGCTGTCTTCTCCAGCTCC | 24104 | ScaCas9 | 48 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 507 | AGG | TGGCTGTCTTCTCCAGCTCC | 24105 | ScaCas9-HiFi-Sc++ | 48 | 0 |
| 508 | AGG | TGGCTGTCTTCTCCAGCTCC | 24106 | ScaCas9-Sc++ | 48 | 0 |
| 509 | AGG | TGGCTGTCTTCTCCAGCTCC | 24107 | SpyCas9 | 48 | 0 |
| 510 | AGG | TGGCTGTCTTCTCCAGCTCC | 24108 | SpyCas9-HF1 | 48 | 0 |
| 511 | AGG | TGGCTGTCTTCTCCAGCTCC | 24109 | SpyCas9-SpG | 48 | 0 |
| 512 | AGG | TGGCTGTCTTCTCCAGCTCC | 24110 | SpyCas9-SpRY | 48 | 0 |
| 513 | AGG | AATGGCCTATGGGATGCAGC | 24111 | ScaCas9 | 48 | 0 |
| 514 | AGG | AATGGCCTATGGGATGCAGC | 24112 | ScaCas9-HiFi-Sc++ | 48 | 0 |
| 515 | AGG | AATGGCCTATGGGATGCAGC | 24113 | ScaCas9-Sc++ | 48 | 0 |
| 516 | AGG | AATGGCCTATGGGATGCAGC | 24114 | SpyCas9 | 48 | 0 |
| 517 | AGG | AATGGCCTATGGGATGCAGC | 24115 | SpyCas9-HF1 | 48 | 0 |
| 518 | AGG | AATGGCCTATGGGATGCAGC | 24116 | SpyCas9-SpG | 48 | 0 |
| 519 | AGG | AATGGCCTATGGGATGCAGC | 24117 | SpyCas9-SpRY | 48 | 0 |
| 520 | AG | TGGCTGTCTTCTCCAGCTCC | 24118 | SpyCas9-NG | 48 | 0 |
| 521 | AG | TGGCTGTCTTCTCCAGCTCC | 24119 | SpyCas9-xCas | 48 | 0 |
| 522 | AG | TGGCTGTCTTCTCCAGCTCC | 24120 | SpyCas9-xCas-NG | 48 | 0 |
| 523 | AG | AATGGCCTATGGGATGCAGC | 24121 | SpyCas9-NG | 48 | 0 |
| 524 | AG | AATGGCCTATGGGATGCAGC | 24122 | SpyCas9-xCas | 48 | 0 |
| 525 | AG | AATGGCCTATGGGATGCAGC | 24123 | SpyCas9-xCas-NG | 48 | 0 |
| 526 | AGGGAAT | AATGGCCTATGGGATGCAGC | 24124 | St1Cas9 | 48 | 0 |
| 527 | AGGGGG | ATGGCTGTCTTCTCCAGCTCC | 24125 | cCas9-v17 | 48 | 0 |
| 528 | AGGGGG | ATGGCTGTCTTCTCCAGCTCC | 24126 | cCas9-v42 | 48 | 0 |
| 529 | AGGGAA | AAATGGCCTATGGGATGCAGC | 24127 | cCas9-v17 | 48 | 0 |
| 530 | AGGGAA | AAATGGCCTATGGGATGCAGC | 24128 | cCas9-v42 | 48 | 0 |
| 531 | CAGGG | tgGATGGCTGTCTTCTCCAGCTC | 24129 | SauCas9 | 49 | 0 |
| 532 | CAGGG | GATGGCTGTCTTCTCCAGCTC | 24130 | SauCas9KKH | 49 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 533 | CAGGG | caCAAATGGCCTATGGGATGCAG | 24131 | SauCas9 | 49 | 0 |
| 534 | CAGGG | CAAATGGCCTATGGGATGCAG | 24132 | SauCas9KKH | 49 | 0 |
| 535 | CAGG | GATGGCTGTCTTCTCCAGCTC | 24133 | SauriCas9 | 49 | 0 |
| 536 | CAGG | GATGGCTGTCTTCTCCAGCTC | 24134 | SauriCas9-KKH | 49 | 0 |
| 537 | CAGG | CAAATGGCCTATGGGATGCAG | 24135 | SauriCas9 | 49 | 0 |
| 538 | CAGG | CAAATGGCCTATGGGATGCAG | 24136 | SauriCas9-KKH | 49 | 0 |
| 539 | CAG | ATGGCTGTCTTCTCCAGCTC | 24137 | ScaCas9 | 49 | 0 |
| 540 | CAG | ATGGCTGTCTTCTCCAGCTC | 24138 | ScaCas9-HiFi-Sc++ | 49 | 0 |
| 541 | CAG | ATGGCTGTCTTCTCCAGCTC | 24139 | ScaCas9-Sc++ | 49 | 0 |
| 542 | CAG | ATGGCTGTCTTCTCCAGCTC | 24140 | SpyCas9-SpRY | 49 | 0 |
| 543 | CAG | AAATGGCCTATGGGATGCAG | 24141 | ScaCas9 | 49 | 0 |
| 544 | CAG | AAATGGCCTATGGGATGCAG | 24142 | ScaCas9-HiFi-Sc++ | 49 | 0 |
| 545 | CAG | AAATGGCCTATGGGATGCAG | 24143 | ScaCas9-Sc++ | 49 | 0 |
| 546 | CAG | AAATGGCCTATGGGATGCAG | 24144 | SpyCas9-SpRY | 49 | 0 |
| 547 | CAGGGG | GATGGCTGTCTTCTCCAGCTC | 24145 | cCas9-v17 | 49 | 0 |
| 548 | CAGGGG | GATGGCTGTCTTCTCCAGCTC | 24146 | cCas9-v42 | 49 | 0 |
| 549 | CAGGGA | CAAATGGCCTATGGGATGCAG | 24147 | cCas9-v17 | 49 | 0 |
| 550 | CAGGGA | CAAATGGCCTATGGGATGCAG | 24148 | cCas9-v42 | 49 | 0 |
| 551 | CCAGG | GGATGGCTGTCTTCTCCAGCT | 24149 | SauCas9KKH | 50 | 0 |
| 552 | GCAGG | ACAAATGGCCTATGGGATGCA | 24150 | SauCas9KKH | 50 | 0 |
| 553 | CCAG | GGATGGCTGTCTTCTCCAGCT | 24151 | SauriCas9-KKH | 50 | 0 |
| 554 | GCAG | ACAAATGGCCTATGGGATGCA | 24152 | SauriCas9-KKH | 50 | 0 |
| 555 | CCA | GATGGCTGTCTTCTCCAGCT | 24153 | SpyCas9-SpRY | 50 | 0 |
| 556 | GCA | CAAATGGCCTATGGGATGCA | 24154 | SpyCas9-SpRY | 50 | 0 |
| 557 | CCAGGG | GGATGGCTGTCTTCTCCAGCT | 24155 | cCas9-v17 | 50 | 0 |
| 558 | CCAGGG | GGATGGCTGTCTTCTCCAGCT | 24156 | cCas9-v42 | 50 | 0 |
| 559 | GCAGGG | ACAAATGGCCTATGGGATGCA | 24157 | cCas9-v17 | 50 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 560 | GCAGGG | ACAAATGGCCTATGGGATGCA | 24158 | cCas9-v42 | 50 | 0 |
| 561 | TCCAG | TGGATGGCTGTCTTCTCCAGC | 24159 | SauCas9KKH | 51 | 0 |
| 562 | AGCAG | CACAAATGGCCTATGGGATGC | 24160 | SauCas9KKH | 51 | 0 |
| 563 | AG | ACAAATGGCCTATGGGATGC | 24161 | SpyCas9-NG | 51 | 0 |
| 564 | AG | ACAAATGGCCTATGGGATGC | 24162 | SpyCas9-xCas | 51 | 0 |
| 565 | AG | ACAAATGGCCTATGGGATGC | 24163 | SpyCas9-xCas-NG | 51 | 0 |
| 566 | AGC | ACAAATGGCCTATGGGATGC | 24164 | SpyCas9-SpG | 51 | 0 |
| 567 | AGC | ACAAATGGCCTATGGGATGC | 24165 | SpyCas9-SpRY | 51 | 0 |
| 568 | TCC | GGATGGCTGTCTTCTCCAGC | 24166 | SpyCas9-SpRY | 51 | 0 |
| 569 | TCCAGG | TGGATGGCTGTCTTCTCCAGC | 24167 | cCas9-v17 | 51 | 0 |
| 570 | TCCAGG | TGGATGGCTGTCTTCTCCAGC | 24168 | cCas9-v42 | 51 | 0 |
| 571 | AGCAGG | CACAAATGGCCTATGGGATGC | 24169 | cCas9-v17 | 51 | 0 |
| 572 | AGCAGG | CACAAATGGCCTATGGGATGC | 24170 | cCas9-v42 | 51 | 0 |
| 573 | AGCA | ACAAATGGCCTATGGGATGC | 24171 | SpyCas9-3var-NRCH | 51 | 0 |
| 574 | CAG | CACAAATGGCCTATGGGATG | 24172 | ScaCas9 | 52 | 0 |
| 575 | CAG | CACAAATGGCCTATGGGATG | 24173 | ScaCas9-HiFi-Sc++ | 52 | 0 |
| 576 | CAG | CACAAATGGCCTATGGGATG | 24174 | ScaCas9-Sc++ | 52 | 0 |
| 577 | CAG | CACAAATGGCCTATGGGATG | 24175 | SpyCas9-SpRY | 52 | 0 |
| 578 | CTC | TGGATGGCTGTCTTCTCCAG | 24176 | SpyCas9-SpRY | 52 | 0 |
| 579 | CAGC | CACAAATGGCCTATGGGATG | 24177 | SpyCas9-3var-NRRH | 52 | 0 |
| 580 | GCAG | GGCACAAATGGCCTATGGGAT | 24178 | SauriCas9-KKH | 53 | 0 |
| 581 | GCT | TTGGATGGCTGTCTTCTCCA | 24179 | SpyCas9-SpRY | 53 | 0 |
| 582 | GCA | GCACAAATGGCCTATGGGAT | 24180 | SpyCas9-SpRY | 53 | 0 |
| 583 | GCTCCAGG | atttTGGATGGCTGTCTTCTCCA | 24181 | BlatCas9 | 53 | 0 |
| 584 | GCAGCAGG | ggggCACAAATGGCCTATGGGAT | 24182 | BlatCas9 | 53 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 585 | GCTCC | atttTGGATGGCTGTCTTCTCCA | 24183 | BlatCas9 | 53 | 0 |
| 586 | GCAGC | ggggCACAAATGGCCTATGGGAT | 24184 | BlatCas9 | 53 | 0 |
| 587 | AGCTCC | taATTTTGGATGGCTGTCTTCTCC | 24185 | Nme2Cas9 | 54 | 0 |
| 588 | TGCAG | GGGCACAAATGGCCTATGGGA | 24186 | SauCas9KKH | 54 | 0 |
| 589 | AG | TTTGGATGGCTGTCTTCTCC | 24187 | SpyCas9-NG | 54 | 0 |
| 590 | AG | TTTGGATGGCTGTCTTCTCC | 24188 | SpyCas9-xCas | 54 | 0 |
| 591 | AG | TTTGGATGGCTGTCTTCTCC | 24189 | SpyCas9-xCas-NG | 54 | 0 |
| 592 | TG | GGCACAAATGGCCTATGGGA | 24190 | SpyCas9-NG | 54 | 0 |
| 593 | TG | GGCACAAATGGCCTATGGGA | 24191 | SpyCas9-xCas | 54 | 0 |
| 594 | TG | GGCACAAATGGCCTATGGGA | 24192 | SpyCas9-xCas-NG | 54 | 0 |
| 595 | AGC | TTTGGATGGCTGTCTTCTCC | 24193 | SpyCas9-SpG | 54 | 0 |
| 596 | AGC | TTTGGATGGCTGTCTTCTCC | 24194 | SpyCas9-SpRY | 54 | 0 |
| 597 | TGC | GGCACAAATGGCCTATGGGA | 24195 | SpyCas9-SpG | 54 | 0 |
| 598 | TGC | GGCACAAATGGCCTATGGGA | 24196 | SpyCas9-SpRY | 54 | 0 |
| 599 | AGCTCCAG | aattTTGGATGGCTGTCTTCTCC | 24197 | BlatCas9 | 54 | 0 |
| 600 | AGCTC | aattTTGGATGGCTGTCTTCTCC | 24198 | BlatCas9 | 54 | 0 |
| 601 | TGCAGC | GGGCACAAATGGCCTATGGGA | 24199 | cCas9-v17 | 54 | 0 |
| 602 | TGCAGC | GGGCACAAATGGCCTATGGGA | 24200 | cCas9-v42 | 54 | 0 |
| 603 | AGCT | TTTGGATGGCTGTCTTCTCC | 24201 | SpyCas9-3var-NRCH | 54 | 0 |
| 604 | TGCA | GGCACAAATGGCCTATGGGA | 24202 | SpyCas9-3var-NRCH | 54 | 0 |
| 605 | CAG | TTTTGGATGGCTGTCTTCTC | 24203 | ScaCas9 | 55 | 0 |
| 606 | CAG | TTTTGGATGGCTGTCTTCTC | 24204 | ScaCas9-HiFi-Sc++ | 55 | 0 |
| 607 | CAG | TTTTGGATGGCTGTCTTCTC | 24205 | ScaCas9-Sc++ | 55 | 0 |
| 608 | CAG | TTTTGGATGGCTGTCTTCTC | 24206 | SpyCas9-SpRY | 55 | 0 |
| 609 | ATG | GGGCACAAATGGCCTATGGG | 24207 | ScaCas9 | 55 | 0 |
| 610 | ATG | GGGCACAAATGGCCTATGGG | 24208 | ScaCas9-HiFi-Sc++ | 55 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 611 | ATG | GGGCACAAATGGCCTATGGG | 24209 | ScaCas9-Sc++ | 55 | 0 |
| 612 | ATG | GGGCACAAATGGCCTATGGG | 24210 | SpyCas9-SpRY | 55 | 0 |
| 613 | CAGCTCC | AATTTTGGATGGCTGTCTTCTC | 24211 | CdiCas9 | 55 | 0 |
| 614 | CAGC | TTTTGGATGGCTGTCTTCTC | 24212 | SpyCas9-3var-NRRH | 55 | 0 |
| 615 | CCAG | AATTTTGGATGGCTGTCTTCT | 24213 | SauriCas9-KKH | 56 | 0 |
| 616 | GAT | GGGGCACAAATGGCCTATGG | 24214 | SpyCas9-SpRY | 56 | 0 |
| 617 | GAT | GGGGCACAAATGGCCTATGG | 24215 | SpyCas9-xCas | 56 | 0 |
| 618 | CCA | ATTTTGGATGGCTGTCTTCT | 24216 | SpyCas9-SpRY | 56 | 0 |
| 619 | CCAGC | gtaaTTTTGGATGGCTGTCTTCT | 24217 | BlatCas9 | 56 | 0 |
| 620 | GATGC | gaagGGGCACAAATGGCCTATGG | 24218 | BlatCas9 | 56 | 0 |
| 621 | CCAGCT | AATTTTGGATGGCTGTCTTCT | 24219 | cCas9-v16 | 56 | 0 |
| 622 | CCAGCT | AATTTTGGATGGCTGTCTTCT | 24220 | cCas9-v21 | 56 | 0 |
| 623 | TCCAG | TAATTTTGGATGGCTGTCTTC | 24221 | SauCas9KKH | 57 | 0 |
| 624 | GG | AGGGGCACAAATGGCCTATG | 24222 | SpyCas9-NG | 57 | 0 |
| 625 | GG | AGGGGCACAAATGGCCTATG | 24223 | SpyCas9-xCas | 57 | 0 |
| 626 | GG | AGGGGCACAAATGGCCTATG | 24224 | SpyCas9-xCas-NG | 57 | 0 |
| 627 | GGA | AGGGGCACAAATGGCCTATG | 24225 | SpyCas9-SpG | 57 | 0 |
| 628 | GGA | AGGGGCACAAATGGCCTATG | 24226 | SpyCas9-SpRY | 57 | 0 |
| 629 | TCC | AATTTTGGATGGCTGTCTTC | 24227 | SpyCas9-SpRY | 57 | 0 |
| 630 | TCCAGC | TAATTTTGGATGGCTGTCTTC | 24228 | cCas9-v17 | 57 | 0 |
| 631 | TCCAGC | TAATTTTGGATGGCTGTCTTC | 24229 | cCas9-v42 | 57 | 0 |
| 632 | GGAT | AGGGGCACAAATGGCCTATG | 24230 | SpyCas9-3var-NRRH | 57 | 0 |
| 633 | GGAT | AGGGGCACAAATGGCCTATG | 24231 | SpyCas9-VQR | 57 | 0 |
| 634 | GGG | AAGGGGCACAAATGGCCTAT | 24232 | ScaCas9 | 58 | 0 |
| 635 | GGG | AAGGGGCACAAATGGCCTAT | 24233 | ScaCas9-HiFi-Sc++ | 58 | 0 |

TABLE 1D-continued

Exemplary gRNA spacer Cas pairs for correcting the pathogenic IVS10-11G > A mutation Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 636 | GGG | AAGGGGCACAAATGGCCTAT | 24234 | ScaCas9-Sc++ | 58 | 0 |
| 637 | GGG | AAGGGGCACAAATGGCCTAT | 24235 | SpyCas9 | 58 | 0 |
| 638 | GGG | AAGGGGCACAAATGGCCTAT | 24236 | SpyCas9-HF1 | 58 | 0 |
| 639 | GGG | AAGGGGCACAAATGGCCTAT | 24237 | SpyCas9-SpG | 58 | 0 |
| 640 | GGG | AAGGGGCACAAATGGCCTAT | 24238 | SpyCas9-SpRY | 58 | 0 |
| 641 | GG | AAGGGGCACAAATGGCCTAT | 24239 | SpyCas9-NG | 58 | 0 |
| 642 | GG | AAGGGGCACAAATGGCCTAT | 24240 | SpyCas9-xCas | 58 | 0 |
| 643 | GG | AAGGGGCACAAATGGCCTAT | 24241 | SpyCas9-xCas-NG | 58 | 0 |
| 644 | CTC | TAATTTTGGATGGCTGTCTT | 24242 | SpyCas9-SpRY | 58 | 0 |
| 645 | GGGATGC | GAAGGGGCACAAATGGCCTAT | 24243 | cCas9-v16 | 58 | 0 |
| 646 | GGGATGC | GAAGGGGCACAAATGGCCTAT | 24244 | cCas9-v21 | 58 | 0 |
| 647 | GGGA | AAGGGGCACAAATGGCCTAT | 24245 | SpyCas9-3var-NRRH | 58 | 0 |
| 648 | TGGGA | agAGAAGGGGCACAAATGGCCTA | 24246 | SauCas9 | 59 | 0 |
| 649 | TGGGA | AGAAGGGGCACAAATGGCCTA | 24247 | SauCas9KKH | 59 | 0 |
| 650 | TGGGAT | agAGAAGGGGCACAAATGGCCTA | 24248 | SauCas9 | 59 | 0 |
| 651 | TGGGAT | AGAAGGGGCACAAATGGCCTA | 24249 | SauCas9KKH | 59 | 0 |
| 652 | TGGGAT | AGAAGGGGCACAAATGGCCTA | 24250 | cCas9-v17 | 59 | 0 |
| 653 | TGGGAT | AGAAGGGGCACAAATGGCCTA | 24251 | cCas9-v42 | 59 | 0 |
| 654 | TGGG | AGAAGGGGCACAAATGGCCTA | 24252 | SauriCas9 | 59 | 0 |
| 655 | TGGG | AGAAGGGGCACAAATGGCCTA | 24253 | SauriCas9-KKH | 59 | 0 |
| 656 | TGG | GAAGGGGCACAAATGGCCTA | 24254 | ScaCas9 | 59 | 0 |
| 657 | TGG | GAAGGGGCACAAATGGCCTA | 24255 | ScaCas9-HiFi-Sc++ | 59 | 0 |
| 658 | TGG | GAAGGGGCACAAATGGCCTA | 24256 | ScaCas9-Sc++ | 59 | 0 |
| 659 | TGG | GAAGGGGCACAAATGGCCTA | 24257 | SpyCas9 | 59 | 0 |
| 660 | TGG | GAAGGGGCACAAATGGCCTA | 24258 | SpyCas9-HF1 | 59 | 0 |
| 661 | TGG | GAAGGGGCACAAATGGCCTA | 24259 | SpyCas9-SpG | 59 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 662 | TGG | GAAGGGGCACAAATGGCCTA | 24260 | SpyCas9-SpRY | 59 | 0 |
| 663 | TG | GAAGGGGCACAAATGGCCTA | 24261 | SpyCas9-NG | 59 | 0 |
| 664 | TG | GAAGGGGCACAAATGGCCTA | 24262 | SpyCas9-xCas | 59 | 0 |
| 665 | TG | GAAGGGGCACAAATGGCCTA | 24263 | SpyCas9-xCas-NG | 59 | 0 |
| 666 | TCT | GTAATTTTGGATGGCTGTCT | 24264 | SpyCas9-SpRY | 59 | 0 |
| 667 | TCTCC | agtgTAATTTTGGATGGCTGTCT | 24265 | BlatCas9 | 59 | 0 |
| 668 | TTCTCC | acAGTGTAATTTTGGATGGCTGTC | 24266 | Nme2Cas9 | 60 | 0 |
| 669 | ATGGG | gaGAGAAGGGGCACAAATGGCCT | 24267 | SauCas9 | 60 | 0 |
| 670 | ATGGG | GAGAAGGGGCACAAATGGCCT | 24268 | SauCas9KKH | 60 | 0 |
| 671 | ATGG | GAGAAGGGGCACAAATGGCCT | 24269 | SauriCas9 | 60 | 0 |
| 672 | ATGG | GAGAAGGGGCACAAATGGCCT | 24270 | SauriCas9-KKH | 60 | 0 |
| 673 | ATG | AGAAGGGGCACAAATGGCCT | 24271 | ScaCas9 | 60 | 0 |
| 674 | ATG | AGAAGGGGCACAAATGGCCT | 24272 | ScaCas9-HiFi-Sc++ | 60 | 0 |
| 675 | ATG | AGAAGGGGCACAAATGGCCT | 24273 | ScaCas9-Sc++ | 60 | 0 |
| 676 | ATG | AGAAGGGGCACAAATGGCCT | 24274 | SpyCas9-SpRY | 60 | 0 |
| 677 | TTC | TGTAATTTTGGATGGCTGTC | 24275 | SpyCas9-SpRY | 60 | 0 |
| 678 | TTCTCCAG | cagtGTAATTTTGGATGGCTGTC | 24276 | BlatCas9 | 60 | 0 |
| 679 | TTCTC | cagtGTAATTTTGGATGGCTGTC | 24277 | BlatCas9 | 60 | 0 |
| 680 | ATGGGA | GAGAAGGGGCACAAATGGCCT | 24278 | cCas9-v17 | 60 | 0 |
| 681 | ATGGGA | GAGAAGGGGCACAAATGGCCT | 24279 | cCas9-v42 | 60 | 0 |
| 682 | TATGG | AGAGAAGGGGCACAAATGGCC | 24280 | SauCas9KKH | 61 | 0 |
| 683 | TAT | GAGAAGGGGCACAAATGGCC | 24281 | SpyCas9-SpRY | 61 | 0 |
| 684 | CTT | GTGTAATTTTGGATGGCTGT | 24282 | SpyCas9-SpRY | 61 | 0 |
| 685 | TCT | AGTGTAATTTTGGATGGCTG | 24283 | SpyCas9-SpRY | 62 | 0 |
| 686 | CTA | AGAGAAGGGGCACAAATGGC | 24284 | SpyCas9-SpRY | 62 | 0 |
| 687 | TCTTC | gacaGTGTAATTTTGGATGGCTG | 24285 | BlatCas9 | 62 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 688 | GTC | CAGTGTAATTTTGGATGGCT | 24286 | SpyCas9-SpRY | 63 | 0 |
| 689 | CCT | GAGAGAAGGGGCACAAATGG | 24287 | SpyCas9-SpRY | 63 | 0 |
| 690 | TG | ACAGTGTAATTTTGGATGGC | 24288 | SpyCas9-NG | 64 | 0 |
| 691 | TG | ACAGTGTAATTTTGGATGGC | 24289 | SpyCas9-xCas | 64 | 0 |
| 692 | TG | ACAGTGTAATTTTGGATGGC | 24290 | SpyCas9-xCas-NG | 64 | 0 |
| 693 | TGT | ACAGTGTAATTTTGGATGGC | 24291 | SpyCas9-SpG | 64 | 0 |
| 694 | TGT | ACAGTGTAATTTTGGATGGC | 24292 | SpyCas9-SpRY | 64 | 0 |
| 695 | GCC | TGAGAGAAGGGGCACAAATG | 24293 | SpyCas9-SpRY | 64 | 0 |
| 696 | TGTC | ACAGTGTAATTTTGGATGGC | 24294 | SpyCas9-3var-NRTH | 64 | 0 |
| 697 | CTG | GACAGTGTAATTTTGGATGG | 24295 | ScaCas9 | 65 | 0 |
| 698 | CTG | GACAGTGTAATTTTGGATGG | 24296 | ScaCas9-HiFi-Sc++ | 65 | 0 |
| 699 | CTG | GACAGTGTAATTTTGGATGG | 24297 | ScaCas9-Sc++ | 65 | 0 |
| 700 | CTG | GACAGTGTAATTTTGGATGG | 24298 | SpyCas9-SpRY | 65 | 0 |
| 701 | GG | ATGAGAGAAGGGGCACAAAT | 24299 | SpyCas9-NG | 65 | 0 |
| 702 | GG | ATGAGAGAAGGGGCACAAAT | 24300 | SpyCas9-xCas | 65 | 0 |
| 703 | GG | ATGAGAGAAGGGGCACAAAT | 24301 | SpyCas9-xCas-NG | 65 | 0 |
| 704 | GGC | ATGAGAGAAGGGGCACAAAT | 24302 | SpyCas9-SpG | 65 | 0 |
| 705 | GGC | ATGAGAGAAGGGGCACAAAT | 24303 | SpyCas9-SpRY | 65 | 0 |
| 706 | CTGTC | cgtgACAGTGTAATTTTGGATGG | 24304 | BlatCas9 | 65 | 0 |
| 707 | CTGTCTT | GTGACAGTGTAATTTTGGATGG | 24305 | CdiCas9 | 65 | 0 |
| 708 | GGCC | ATGAGAGAAGGGGCACAAAT | 24306 | SpyCas9-3var-NRCH | 65 | 0 |
| 709 | TGG | GATGAGAGAAGGGGCACAAA | 24307 | ScaCas9 | 66 | 0 |
| 710 | TGG | GATGAGAGAAGGGGCACAAA | 24308 | ScaCas9-HiFi-Sc++ | 66 | 0 |
| 711 | TGG | GATGAGAGAAGGGGCACAAA | 24309 | ScaCas9-Sc++ | 66 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 712 | TGG | GATGAGAGAAGGGGCACAAA | 24310 | SpyCas9 | 66 | 0 |
| 713 | TGG | GATGAGAGAAGGGGCACAAA | 24311 | SpyCas9-HF1 | 66 | 0 |
| 714 | TGG | GATGAGAGAAGGGGCACAAA | 24312 | SpyCas9-SpG | 66 | 0 |
| 715 | TGG | GATGAGAGAAGGGGCACAAA | 24313 | SpyCas9-SpRY | 66 | 0 |
| 716 | TG | GATGAGAGAAGGGGCACAAA | 24314 | SpyCas9-NG | 66 | 0 |
| 717 | TG | GATGAGAGAAGGGGCACAAA | 24315 | SpyCas9-xCas | 66 | 0 |
| 718 | TG | GATGAGAGAAGGGGCACAAA | 24316 | SpyCas9-xCas-NG | 66 | 0 |
| 719 | GCT | TGACAGTGTAATTTTGGATG | 24317 | SpyCas9-SpRY | 66 | 0 |
| 720 | TGGCCTAT | tgagATGAGAGAAGGGGCACAAA | 24318 | BlatCas9 | 66 | 0 |
| 721 | TGGCC | tgagATGAGAGAAGGGGCACAAA | 24319 | BlatCas9 | 66 | 0 |
| 722 | TGGC | GATGAGAGAAGGGGCACAAA | 24320 | SpyCas9-3var-NRRH | 66 | 0 |
| 723 | ATGGCC | ggTGAGATGAGAGAAGGGGCACAA | 24321 | Nme2Cas9 | 67 | 0 |
| 724 | ATGG | GAGATGAGAGAAGGGGCACAA | 24322 | SauriCas9 | 67 | 0 |
| 725 | ATGG | GAGATGAGAGAAGGGGCACAA | 24323 | SauriCas9-KKH | 67 | 0 |
| 726 | ATG | AGATGAGAGAAGGGGCACAA | 24324 | ScaCas9 | 67 | 0 |
| 727 | ATG | AGATGAGAGAAGGGGCACAA | 24325 | ScaCas9-HiFi-Sc++ | 67 | 0 |
| 728 | ATG | AGATGAGAGAAGGGGCACAA | 24326 | ScaCas9-Sc++ | 67 | 0 |
| 729 | ATG | AGATGAGAGAAGGGGCACAA | 24327 | SpyCas9-SpRY | 67 | 0 |
| 730 | GG | GTGACAGTGTAATTTTGGAT | 24328 | SpyCas9-NG | 67 | 0 |
| 731 | GG | GTGACAGTGTAATTTTGGAT | 24329 | SpyCas9-xCas | 67 | 0 |
| 732 | GG | GTGACAGTGTAATTTTGGAT | 24330 | SpyCas9-xCas-NG | 67 | 0 |
| 733 | GGC | GTGACAGTGTAATTTTGGAT | 24331 | SpyCas9-SpG | 67 | 0 |
| 734 | GGC | GTGACAGTGTAATTTTGGAT | 24332 | SpyCas9-SpRY | 67 | 0 |
| 735 | ATGGCCTA | gtgaGATGAGAGAAGGGGCACAA | 24333 | BlatCas9 | 67 | 0 |
| 736 | ATGGC | gtgaGATGAGAGAAGGGGCACAA | 24334 | BlatCas9 | 67 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 737 | GGCTGTCT | ctccGTGACAGTGTAATTTTGGAT | 24335 | NmeCas9 | 67 | 0 |
| 738 | GGCT | GTGACAGTGTAATTTTGGAT | 24336 | SpyCas9-3var-NRCH | 67 | 0 |
| 739 | AATGG | TGAGATGAGAGAAGGGGCACA | 24337 | SauCas9KKH | 68 | 0 |
| 740 | TGG | CGTGACAGTGTAATTTTGGA | 24338 | ScaCas9 | 68 | 0 |
| 741 | TGG | CGTGACAGTGTAATTTTGGA | 24339 | ScaCas9-HiFi-Sc++ | 68 | 0 |
| 742 | TGG | CGTGACAGTGTAATTTTGGA | 24340 | ScaCas9-Sc++ | 68 | 0 |
| 743 | TGG | CGTGACAGTGTAATTTTGGA | 24341 | SpyCas9 | 68 | 0 |
| 744 | TGG | CGTGACAGTGTAATTTTGGA | 24342 | SpyCas9-HF1 | 68 | 0 |
| 745 | TGG | CGTGACAGTGTAATTTTGGA | 24343 | SpyCas9-SpG | 68 | 0 |
| 746 | TGG | CGTGACAGTGTAATTTTGGA | 24344 | SpyCas9-SpRY | 68 | 0 |
| 747 | TG | CGTGACAGTGTAATTTTGGA | 24345 | SpyCas9-NG | 68 | 0 |
| 748 | TG | CGTGACAGTGTAATTTTGGA | 24346 | SpyCas9-xCas | 68 | 0 |
| 749 | TG | CGTGACAGTGTAATTTTGGA | 24347 | SpyCas9-xCas-NG | 68 | 0 |
| 750 | AAT | GAGATGAGAGAAGGGGCACA | 24348 | SpyCas9-SpRY | 68 | 0 |
| 751 | TGGC | CGTGACAGTGTAATTTTGGA | 24349 | SpyCas9-3var-NRRH | 68 | 0 |
| 752 | ATGG | TCCGTGACAGTGTAATTTTGG | 24350 | SauriCas9 | 69 | 0 |
| 753 | ATGG | TCCGTGACAGTGTAATTTTGG | 24351 | SauriCas9-KKH | 69 | 0 |
| 754 | ATG | CCGTGACAGTGTAATTTTGG | 24352 | ScaCas9 | 69 | 0 |
| 755 | ATG | CCGTGACAGTGTAATTTTGG | 24353 | ScaCas9-HiFi-Sc++ | 69 | 0 |
| 756 | ATG | CCGTGACAGTGTAATTTTGG | 24354 | ScaCas9-Sc++ | 69 | 0 |
| 757 | ATG | CCGTGACAGTGTAATTTTGG | 24355 | SpyCas9-SpRY | 69 | 0 |
| 758 | AAA | TGAGATGAGAGAAGGGGCAC | 24356 | SpyCas9-SpRY | 69 | 0 |
| 759 | ATGGCTGT | actcCGTGACAGTGTAATTTTGG | 24357 | BlatCas9 | 69 | 0 |
| 760 | ATGGC | actcCGTGACAGTGTAATTTTGG | 24358 | BlatCas9 | 69 | 0 |
| 761 | ATGGCT | TCCGTGACAGTGTAATTTTGG | 24359 | cCas9-v16 | 69 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 762 | ATGGCT | TCCGTGACAGTGTAATTTTGG | 24360 | cCas9-v21 | 69 | 0 |
| 763 | AAAT | TGAGATGAGAGAAGGGGCAC | 24361 | SpyCas9-3var-NRRH | 69 | 0 |
| 764 | AAAT | gtGAGATGAGAGAAGGGGCAC | 24362 | iSpyMacCas9 | 69 | 0 |
| 765 | GATGG | CTCCGTGACAGTGTAATTTTG | 24363 | SauCas9KKH | 70 | 0 |
| 766 | GAT | TCCGTGACAGTGTAATTTTG | 24364 | SpyCas9-SpRY | 70 | 0 |
| 767 | GAT | TCCGTGACAGTGTAATTTTG | 24365 | SpyCas9-xCas | 70 | 0 |
| 768 | CAA | GTGAGATGAGAGAAGGGGCA | 24366 | SpyCas9-SpRY | 70 | 0 |
| 769 | CAAA | GTGAGATGAGAGAAGGGGCA | 24367 | SpyCas9-3var-NRRH | 70 | 0 |
| 770 | CAAA | ggTGAGATGAGAGAAGGGGCA | 24368 | iSpyMacCas9 | 70 | 0 |
| 771 | ACAAA | GGGTGAGATGAGAGAAGGGGC | 24369 | SauCas9KKH | 71 | 0 |
| 772 | ACAAAT | GGGTGAGATGAGAGAAGGGGC | 24370 | SauCas9KKH | 71 | 0 |
| 773 | ACAAAT | GGGTGAGATGAGAGAAGGGGC | 24371 | cCas9-v17 | 71 | 0 |
| 774 | ACAAAT | GGGTGAGATGAGAGAAGGGGC | 24372 | cCas9-v42 | 71 | 0 |
| 775 | GG | CTCCGTGACAGTGTAATTTT | 24373 | SpyCas9-NG | 71 | 0 |
| 776 | GG | CTCCGTGACAGTGTAATTTT | 24374 | SpyCas9-xCas | 71 | 0 |
| 777 | GG | CTCCGTGACAGTGTAATTTT | 24375 | SpyCas9-xCas-NG | 71 | 0 |
| 778 | GGA | CTCCGTGACAGTGTAATTTT | 24376 | SpyCas9-SpG | 71 | 0 |
| 779 | GGA | CTCCGTGACAGTGTAATTTT | 24377 | SpyCas9-SpRY | 71 | 0 |
| 780 | ACA | GGTGAGATGAGAGAAGGGGC | 24378 | SpyCas9-SpRY | 71 | 0 |
| 781 | GGAT | CTCCGTGACAGTGTAATTTT | 24379 | SpyCas9-3var-NRRH | 71 | 0 |
| 782 | GGAT | CTCCGTGACAGTGTAATTTT | 24380 | SpyCas9-VQR | 71 | 0 |
| 783 | CACAA | GGGGTGAGATGAGAGAAGGGG | 24381 | SauCas9KKH | 72 | 0 |
| 784 | TGG | ACTCCGTGACAGTGTAATTT | 24382 | ScaCas9 | 72 | 0 |
| 785 | TGG | ACTCCGTGACAGTGTAATTT | 24383 | ScaCas9-HiFi-Sc++ | 72 | 0 |
| 786 | TGG | ACTCCGTGACAGTGTAATTT | 24384 | ScaCas9-Sc++ | 72 | 0 |
| 787 | TGG | ACTCCGTGACAGTGTAATTT | 24385 | SpyCas9 | 72 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 788 | TGG | ACTCCGTGACAGTGTAATTT | 24386 | SpyCas9-HF1 | 72 | 0 |
| 789 | TGG | ACTCCGTGACAGTGTAATTT | 24387 | SpyCas9-SpG | 72 | 0 |
| 790 | TGG | ACTCCGTGACAGTGTAATTT | 24388 | SpyCas9-SpRY | 72 | 0 |
| 791 | TG | ACTCCGTGACAGTGTAATTT | 24389 | SpyCas9-NG | 72 | 0 |
| 792 | TG | ACTCCGTGACAGTGTAATTT | 24390 | SpyCas9-xCas | 72 | 0 |
| 793 | TG | ACTCCGTGACAGTGTAATTT | 24391 | SpyCas9-xCas-NG | 72 | 0 |
| 794 | CAC | GGGTGAGATGAGAGAAGGGG | 24392 | SpyCas9-SpRY | 72 | 0 |
| 795 | CACAAA | GGGGTGAGATGAGAGAAGGGG | 24393 | cCas9-v17 | 72 | 0 |
| 796 | CACAAA | GGGGTGAGATGAGAGAAGGGG | 24394 | cCas9-v42 | 72 | 0 |
| 797 | TGGA | ACTCCGTGACAGTGTAATTT | 24395 | SpyCas9-3var-NRRH | 72 | 0 |
| 798 | CACA | GGGTGAGATGAGAGAAGGGG | 24396 | SpyCas9-3var-NRCH | 72 | 0 |
| 799 | TTGGA | tgGAACTCCGTGACAGTGTAATT | 24397 | SauCas9 | 73 | 0 |
| 800 | TTGGA | GAACTCCGTGACAGTGTAATT | 24398 | SauCas9KKH | 73 | 0 |
| 801 | TTGGAT | tgGAACTCCGTGACAGTGTAATT | 24399 | SauCas9 | 73 | 0 |
| 802 | TTGGAT | GAACTCCGTGACAGTGTAATT | 24400 | SauCas9KKH | 73 | 0 |
| 803 | TTGGAT | GAACTCCGTGACAGTGTAATT | 24401 | cCas9-v17 | 73 | 0 |
| 804 | TTGGAT | GAACTCCGTGACAGTGTAATT | 24402 | cCas9-v42 | 73 | 0 |
| 805 | TTGG | GAACTCCGTGACAGTGTAATT | 24403 | SauriCas9 | 73 | 0 |
| 806 | TTGG | GAACTCCGTGACAGTGTAATT | 24404 | SauriCas9-KKH | 73 | 0 |
| 807 | TTG | AACTCCGTGACAGTGTAATT | 24405 | ScaCas9 | 73 | 0 |
| 808 | TTG | AACTCCGTGACAGTGTAATT | 24406 | ScaCas9-HiFi-Sc++ | 73 | 0 |
| 809 | TTG | AACTCCGTGACAGTGTAATT | 24407 | ScaCas9-Sc++ | 73 | 0 |
| 810 | TTG | AACTCCGTGACAGTGTAATT | 24408 | SpyCas9-SpRY | 73 | 0 |
| 811 | GCA | GGGGTGAGATGAGAGAAGGG | 24409 | SpyCas9-SpRY | 73 | 0 |
| 812 | GCACAA | GGGGTGAGATGAGAGAAGGG | 24410 | St1Cas9-CNRZ1066 | 73 | 0 |
| 813 | TTTGG | GGAACTCCGTGACAGTGTAAT | 24411 | SauCas9KKH | 74 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 814 | GG | CGGGGTGAGATGAGAGAAGG | 24412 | SpyCas9-NG | 74 | 0 |
| 815 | GG | CGGGGTGAGATGAGAGAAGG | 24413 | SpyCas9-xCas | 74 | 0 |
| 816 | GG | CGGGGTGAGATGAGAGAAGG | 24414 | SpyCas9-xCas-NG | 74 | 0 |
| 817 | GGC | CGGGGTGAGATGAGAGAAGG | 24415 | SpyCas9-SpG | 74 | 0 |
| 818 | GGC | CGGGGTGAGATGAGAGAAGG | 24416 | SpyCas9-SpRY | 74 | 0 |
| 819 | TTT | GAACTCCGTGACAGTGTAAT | 24417 | SpyCas9-SpRY | 74 | 0 |
| 820 | GGCACAAA | aatcGGGGTGAGATGAGAGAAGG | 24418 | BlatCas9 | 74 | 0 |
| 821 | GGCACAAA | aatcGGGGTGAGATGAGAGAAGG | 24419 | BlatCas9 | 74 | 0 |
| 822 | GGCACAAA | aaTCGGGGTGAGATGAGAGAAGG | 24420 | GeoCas9 | 74 | 0 |
| 823 | GGCAC | aatcGGGGTGAGATGAGAGAAGG | 24421 | BlatCas9 | 74 | 0 |
| 824 | GGCA | CGGGGTGAGATGAGAGAAGG | 24422 | SpyCas9-3var-NRCH | 74 | 0 |
| 825 | GGG | TCGGGGTGAGATGAGAGAAG | 24423 | ScaCas9 | 75 | 0 |
| 826 | GGG | TCGGGGTGAGATGAGAGAAG | 24424 | ScaCas9-HiFi-Sc++ | 75 | 0 |
| 827 | GGG | TCGGGGTGAGATGAGAGAAG | 24425 | ScaCas9-Sc++ | 75 | 0 |
| 828 | GGG | TCGGGGTGAGATGAGAGAAG | 24426 | SpyCas9 | 75 | 0 |
| 829 | GGG | TCGGGGTGAGATGAGAGAAG | 24427 | SpyCas9-HF1 | 75 | 0 |
| 830 | GGG | TCGGGGTGAGATGAGAGAAG | 24428 | SpyCas9-SpG | 75 | 0 |
| 831 | GGG | TCGGGGTGAGATGAGAGAAG | 24429 | SpyCas9-SpRY | 75 | 0 |
| 832 | GG | TCGGGGTGAGATGAGAGAAG | 24430 | SpyCas9-NG | 75 | 0 |
| 833 | GG | TCGGGGTGAGATGAGAGAAG | 24431 | SpyCas9-xCas | 75 | 0 |
| 834 | GG | TCGGGGTGAGATGAGAGAAG | 24432 | SpyCas9-xCas-NG | 75 | 0 |
| 835 | TTT | GGAACTCCGTGACAGTGTAA | 24433 | SpyCas9-SpRY | 75 | 0 |
| 836 | GGGC | TCGGGGTGAGATGAGAGAAG | 24434 | SpyCas9-3var-NRRH | 75 | 0 |
| 837 | GGGG | AATCGGGGTGAGATGAGAGAA | 24435 | SauriCas9 | 76 | 0 |

TABLE 1D-continued

Exemplary gRNA spacer Cas pairs for correcting the pathogenic IVS10-11G > A mutation Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 838 | GGGG | AATCGGGGTGAGATGAGAGAA | 24436 | SauriCas9-KKH | 76 | 0 |
| 839 | GGG | ATCGGGGTGAGATGAGAGAA | 24437 | ScaCas9 | 76 | 0 |
| 840 | GGG | ATCGGGGTGAGATGAGAGAA | 24438 | ScaCas9-HiFi-Sc++ | 76 | 0 |
| 841 | GGG | ATCGGGGTGAGATGAGAGAA | 24439 | ScaCas9-Sc++ | 76 | 0 |
| 842 | GGG | ATCGGGGTGAGATGAGAGAA | 24440 | SpyCas9 | 76 | 0 |
| 843 | GGG | ATCGGGGTGAGATGAGAGAA | 24441 | SpyCas9-HF1 | 76 | 0 |
| 844 | GGG | ATCGGGGTGAGATGAGAGAA | 24442 | SpyCas9-SpG | 76 | 0 |
| 845 | GGG | ATCGGGGTGAGATGAGAGAA | 24443 | SpyCas9-SpRY | 76 | 0 |
| 846 | GG | ATCGGGGTGAGATGAGAGAA | 24444 | SpyCas9-NG | 76 | 0 |
| 847 | GG | ATCGGGGTGAGATGAGAGAA | 24445 | SpyCas9-xCas | 76 | 0 |
| 848 | GG | ATCGGGGTGAGATGAGAGAA | 24446 | SpyCas9-xCas-NG | 76 | 0 |
| 849 | ATT | TGGAACTCCGTGACAGTGTA | 24447 | SpyCas9-SpRY | 76 | 0 |
| 850 | GGGGC | ggaaTCGGGGTGAGATGAGAGAA | 24448 | BlatCas9 | 76 | 0 |
| 851 | AGGGG | agGAATCGGGGTGAGATGAGAGA | 24449 | SauCas9 | 77 | 0 |
| 852 | AGGGG | GAATCGGGGTGAGATGAGAGA | 24450 | SauCas9KKH | 77 | 0 |
| 853 | AGGG | GAATCGGGGTGAGATGAGAGA | 24451 | SauriCas9 | 77 | 0 |
| 854 | AGGG | GAATCGGGGTGAGATGAGAGA | 24452 | SauriCas9-KKH | 77 | 0 |
| 855 | AGG | AATCGGGGTGAGATGAGAGA | 24453 | ScaCas9 | 77 | 0 |
| 856 | AGG | AATCGGGGTGAGATGAGAGA | 24454 | ScaCas9-HiFi-Sc++ | 77 | 0 |
| 857 | AGG | AATCGGGGTGAGATGAGAGA | 24455 | ScaCas9-Sc++ | 77 | 0 |
| 858 | AGG | AATCGGGGTGAGATGAGAGA | 24456 | SpyCas9 | 77 | 0 |
| 859 | AGG | AATCGGGGTGAGATGAGAGA | 24457 | SpyCas9-HF1 | 77 | 0 |
| 860 | AGG | AATCGGGGTGAGATGAGAGA | 24458 | SpyCas9-SpG | 77 | 0 |
| 861 | AGG | AATCGGGGTGAGATGAGAGA | 24459 | SpyCas9-SpRY | 77 | 0 |
| 862 | AG | AATCGGGGTGAGATGAGAGA | 24460 | SpyCas9-NG | 77 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 863 | AG | AATCGGGGTGAGATGAGAGA | 24461 | SpyCas9-xCas | 77 | 0 |
| 864 | AG | AATCGGGGTGAGATGAGAGA | 24462 | SpyCas9-xCas-NG | 77 | 0 |
| 865 | AAT | CTGGAACTCCGTGACAGTGT | 24463 | SpyCas9-SpRY | 77 | 0 |
| 866 | AGGGGC | GAATCGGGGTGAGATGAGAGA | 24464 | cCas9-v17 | 77 | 0 |
| 867 | AGGGGC | GAATCGGGGTGAGATGAGAGA | 24465 | cCas9-v42 | 77 | 0 |
| 868 | AGGGGCAC | agGAATCGGGGTGAGATGAGAGA | 24466 | CjeCas9 | 77 | 0 |
| 869 | AATT | CTGGAACTCCGTGACAGTGT | 24467 | SpyCas9-3var-NRTH | 77 | 0 |
| 870 | AAGGG | aaGGAATCGGGGTGAGATGAGAG | 24468 | SauCas9 | 78 | 0 |
| 871 | AAGGG | GGAATCGGGGTGAGATGAGAG | 24469 | SauCas9KKH | 78 | 0 |
| 872 | AAGG | GGAATCGGGGTGAGATGAGAG | 24470 | SauriCas9 | 78 | 0 |
| 873 | AAGG | GGAATCGGGGTGAGATGAGAG | 24471 | SauriCas9-KKH | 78 | 0 |
| 874 | AAG | GAATCGGGGTGAGATGAGAG | 24472 | ScaCas9 | 78 | 0 |
| 875 | AAG | GAATCGGGGTGAGATGAGAG | 24473 | ScaCas9-HiFi-Sc++ | 78 | 0 |
| 876 | AAG | GAATCGGGGTGAGATGAGAG | 24474 | ScaCas9-Sc++ | 78 | 0 |
| 877 | AAG | GAATCGGGGTGAGATGAGAG | 24475 | SpyCas9-SpRY | 78 | 0 |
| 878 | TAA | GCTGGAACTCCGTGACAGTG | 24476 | SpyCas9-SpRY | 78 | 0 |
| 879 | AAGGGG | GGAATCGGGGTGAGATGAGAG | 24477 | cCas9-v17 | 78 | 0 |
| 880 | AAGGGG | GGAATCGGGGTGAGATGAGAG | 24478 | cCas9-v42 | 78 | 0 |
| 881 | TAATTTT | GGGCTGGAACTCCGTGACAGTG | 24479 | CdiCas9 | 78 | 0 |
| 882 | TAAT | GCTGGAACTCCGTGACAGTG | 24480 | SpyCas9-3var-NRRH | 78 | 0 |
| 883 | TAAT | ggCTGGAACTCCGTGACAGTG | 24481 | iSpyMacCas9 | 78 | 0 |
| 884 | GAAGG | AGGAATCGGGGTGAGATGAGA | 24482 | SauCas9KKH | 79 | 0 |
| 885 | GAAG | AGGAATCGGGGTGAGATGAGA | 24483 | SauriCas9-KKH | 79 | 0 |
| 886 | GAAG | GGAATCGGGGTGAGATGAGA | 24484 | SpyCas9-QQR1 | 79 | 0 |
| 887 | GAAG | agGAATCGGGGTGAGATGAGA | 24485 | iSpyMacCas9 | 79 | 0 |
| 888 | GAA | GGAATCGGGGTGAGATGAGA | 24486 | SpyCas9-SpRY | 79 | 0 |

TABLE 1D-continued

Exemplary gRNA spacer Cas pairs for correcting the pathogenic IVS10-11G > A mutation Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 889 | GAA | GGAATCGGGGTGAGATGAGA | 24487 | SpyCas9-xCas | 79 | 0 |
| 890 | GTA | GGCTGGAACTCCGTGACAGT | 24488 | SpyCas9-SpRY | 79 | 0 |
| 891 | GTAATT | GGGCTGGAACTCCGTGACAGT | 24489 | cCas9-v16 | 79 | 0 |
| 892 | GTAATT | GGGCTGGAACTCCGTGACAGT | 24490 | cCas9-v21 | 79 | 0 |
| 893 | GAAGGG | AGGAATCGGGGTGAGATGAGA | 24491 | cCas9-v17 | 79 | 0 |
| 894 | GAAGGG | AGGAATCGGGGTGAGATGAGA | 24492 | cCas9-v42 | 79 | 0 |
| 895 | GTAATTT | GGGGCTGGAACTCCGTGACAGT | 24493 | CdiCas9 | 79 | 0 |
| 896 | TGTAATT | agaGGGGCTGGAACTCCGTGACAG | 24494 | PpnCas9 | 80 | 0 |
| 897 | TGTAA | GGGGCTGGAACTCCGTGACAG | 24495 | SauCas9KKH | 80 | 0 |
| 898 | AGAAG | AAGGAATCGGGGTGAGATGAG | 24496 | SauCas9KKH | 80 | 0 |
| 899 | TGTAAT | GGGGCTGGAACTCCGTGACAG | 24497 | SauCas9KKH | 80 | 0 |
| 900 | TG | GGGCTGGAACTCCGTGACAG | 24498 | SpyCas9-NG | 80 | 0 |
| 901 | TG | GGGCTGGAACTCCGTGACAG | 24499 | SpyCas9-xCas | 80 | 0 |
| 902 | TG | GGGCTGGAACTCCGTGACAG | 24500 | SpyCas9-xCas-NG | 80 | 0 |
| 903 | AG | AGGAATCGGGGTGAGATGAG | 24501 | SpyCas9-NG | 80 | 0 |
| 904 | AG | AGGAATCGGGGTGAGATGAG | 24502 | SpyCas9-xCas | 80 | 0 |
| 905 | AG | AGGAATCGGGGTGAGATGAG | 24503 | SpyCas9-xCas-NG | 80 | 0 |
| 906 | TGT | GGGCTGGAACTCCGTGACAG | 24504 | SpyCas9-SpG | 80 | 0 |
| 907 | TGT | GGGCTGGAACTCCGTGACAG | 24505 | SpyCas9-SpRY | 80 | 0 |
| 908 | AGA | AGGAATCGGGGTGAGATGAG | 24506 | SpyCas9-SpG | 80 | 0 |
| 909 | AGA | AGGAATCGGGGTGAGATGAG | 24507 | SpyCas9-SpRY | 80 | 0 |
| 910 | AGAAGG | AAGGAATCGGGGTGAGATGAG | 24508 | cCas9-v17 | 80 | 0 |
| 911 | AGAAGG | AAGGAATCGGGGTGAGATGAG | 24509 | cCas9-v42 | 80 | 0 |
| 912 | AGAA | AGGAATCGGGGTGAGATGAG | 24510 | SpyCas9-3var-NRRH | 80 | 0 |
| 913 | AGAA | AGGAATCGGGGTGAGATGAG | 24511 | SpyCas9-VQR | 80 | 0 |
| 914 | TGTA | GGGCTGGAACTCCGTGACAG | 24512 | SpyCas9-3var-NRTH | 80 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 915 | GAGAA | taGAAGGAATCGGGGTGAGATGA | 24513 | SauCas9 | 81 | 0 |
| 916 | GAGAA | GAAGGAATCGGGGTGAGATGA | 24514 | SauCas9KKH | 81 | 0 |
| 917 | GTG | GGGGCTGGAACTCCGTGACA | 24515 | ScaCas9 | 81 | 0 |
| 918 | GTG | GGGGCTGGAACTCCGTGACA | 24516 | ScaCas9-HiFi-Sc++ | 81 | 0 |
| 919 | GTG | GGGGCTGGAACTCCGTGACA | 24517 | ScaCas9-Sc++ | 81 | 0 |
| 920 | GTG | GGGGCTGGAACTCCGTGACA | 24518 | SpyCas9-SpRY | 81 | 0 |
| 921 | GAG | AAGGAATCGGGGTGAGATGA | 24519 | ScaCas9 | 81 | 0 |
| 922 | GAG | AAGGAATCGGGGTGAGATGA | 24520 | ScaCas9-HiFi-Sc++ | 81 | 0 |
| 923 | GAG | AAGGAATCGGGGTGAGATGA | 24521 | ScaCas9-Sc++ | 81 | 0 |
| 924 | GAG | AAGGAATCGGGGTGAGATGA | 24522 | SpyCas9-SpRY | 81 | 0 |
| 925 | GAGAAG | GAAGGAATCGGGGTGAGATGA | 24523 | cCas9-v17 | 81 | 0 |
| 926 | GAGAAG | GAAGGAATCGGGGTGAGATGA | 24524 | cCas9-v42 | 81 | 0 |
| 927 | GTGTAAT | GAGGGGCTGGAACTCCGTGACA | 24525 | CdiCas9 | 81 | 0 |
| 928 | GAGA | AAGGAATCGGGGTGAGATGA | 24526 | SpyCas9-3var-NRRH | 81 | 0 |
| 929 | AGAGA | AGAAGGAATCGGGGTGAGATG | 24527 | SauCas9KKH | 82 | 0 |
| 930 | AGAG | AGAAGGAATCGGGGTGAGATG | 24528 | SauriCas9-KKH | 82 | 0 |
| 931 | AGAG | GAAGGAATCGGGGTGAGATG | 24529 | SpyCas9-VQR | 82 | 0 |
| 932 | AG | AGGGGCTGGAACTCCGTGAC | 24530 | SpyCas9-NG | 82 | 0 |
| 933 | AG | AGGGGCTGGAACTCCGTGAC | 24531 | SpyCas9-xCas | 82 | 0 |
| 934 | AG | AGGGGCTGGAACTCCGTGAC | 24532 | SpyCas9-xCas-NG | 82 | 0 |
| 935 | AG | GAAGGAATCGGGGTGAGATG | 24533 | SpyCas9-NG | 82 | 0 |
| 936 | AG | GAAGGAATCGGGGTGAGATG | 24534 | SpyCas9-xCas | 82 | 0 |
| 937 | AG | GAAGGAATCGGGGTGAGATG | 24535 | SpyCas9-xCas-NG | 82 | 0 |
| 938 | AGT | AGGGGCTGGAACTCCGTGAC | 24536 | SpyCas9-SpG | 82 | 0 |
| 939 | AGT | AGGGGCTGGAACTCCGTGAC | 24537 | SpyCas9-SpRY | 82 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 940 | AGA | GAAGGAATCGGGGTGAGATG | 24538 | SpyCas9-SpG | 82 | 0 |
| 941 | AGA | GAAGGAATCGGGGTGAGATG | 24539 | SpyCas9-SpRY | 82 | 0 |
| 942 | AGAGAA | AGAAGGAATCGGGGTGAGATG | 24540 | cCas9-v17 | 82 | 0 |
| 943 | AGAGAA | AGAAGGAATCGGGGTGAGATG | 24541 | cCas9-v42 | 82 | 0 |
| 944 | GAGAG | tgTAGAAGGAATCGGGGTGAGAT | 24542 | SauCas9 | 83 | 0 |
| 945 | GAGAG | TAGAAGGAATCGGGGTGAGAT | 24543 | SauCas9KKH | 83 | 0 |
| 946 | CAG | GAGGGGCTGGAACTCCGTGA | 24544 | ScaCas9 | 83 | 0 |
| 947 | CAG | GAGGGGCTGGAACTCCGTGA | 24545 | ScaCas9-HiFi-Sc++ | 83 | 0 |
| 948 | CAG | GAGGGGCTGGAACTCCGTGA | 24546 | ScaCas9-Sc++ | 83 | 0 |
| 949 | CAG | GAGGGGCTGGAACTCCGTGA | 24547 | SpyCas9-SpRY | 83 | 0 |
| 950 | GAG | AGAAGGAATCGGGGTGAGAT | 24548 | ScaCas9 | 83 | 0 |
| 951 | GAG | AGAAGGAATCGGGGTGAGAT | 24549 | ScaCas9-HiFi-Sc++ | 83 | 0 |
| 952 | GAG | AGAAGGAATCGGGGTGAGAT | 24550 | ScaCas9-Sc++ | 83 | 0 |
| 953 | GAG | AGAAGGAATCGGGGTGAGAT | 24551 | SpyCas9-SpRY | 83 | 0 |
| 954 | GAGAGA | TAGAAGGAATCGGGGTGAGAT | 24552 | cCas9-v17 | 83 | 0 |
| 955 | GAGAGA | TAGAAGGAATCGGGGTGAGAT | 24553 | cCas9-v42 | 83 | 0 |
| 956 | CAGT | GAGGGGCTGGAACTCCGTGA | 24554 | SpyCas9-3var-NRRH | 83 | 0 |
| 957 | GAGA | AGAAGGAATCGGGGTGAGAT | 24555 | SpyCas9-3var-NRRH | 83 | 0 |
| 958 | TGAGA | GTAGAAGGAATCGGGGTGAGA | 24556 | SauCas9KKH | 84 | 0 |
| 959 | ACAG | TAGAGGGGCTGGAACTCCGTG | 24557 | SauriCas9-KKH | 84 | 0 |
| 960 | TGAG | GTAGAAGGAATCGGGGTGAGA | 24558 | SauriCas9-KKH | 84 | 0 |
| 961 | TGAG | TAGAAGGAATCGGGGTGAGA | 24559 | SpyCas9-VQR | 84 | 0 |
| 962 | TG | TAGAAGGAATCGGGGTGAGA | 24560 | SpyCas9-NG | 84 | 0 |
| 963 | TG | TAGAAGGAATCGGGGTGAGA | 24561 | SpyCas9-xCas | 84 | 0 |
| 964 | TG | TAGAAGGAATCGGGGTGAGA | 24562 | SpyCas9-xCas-NG | 84 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 965 | TGA | TAGAAGGAATCGGGGTGAGA | 24563 | SpyCas9-SpG | 84 | 0 |
| 966 | TGA | TAGAAGGAATCGGGGTGAGA | 24564 | SpyCas9-SpRY | 84 | 0 |
| 967 | ACA | AGAGGGGCTGGAACTCCGTG | 24565 | SpyCas9-SpRY | 84 | 0 |
| 968 | ACAGTG | TAGAGGGGCTGGAACTCCGTG | 24566 | cCas9-v16 | 84 | 0 |
| 969 | ACAGTG | TAGAGGGGCTGGAACTCCGTG | 24567 | cCas9-v21 | 84 | 0 |
| 970 | TGAGAG | GTAGAAGGAATCGGGGTGAGA | 24568 | cCas9-v17 | 84 | 0 |
| 971 | TGAGAG | GTAGAAGGAATCGGGGTGAGA | 24569 | cCas9-v42 | 84 | 0 |
| 972 | ATGAG | gaTGTAGAAGGAATCGGGGTGAG | 24570 | SauCas9 | 85 | 0 |
| 973 | ATGAG | TGTAGAAGGAATCGGGGTGAG | 24571 | SauCas9KKH | 85 | 0 |
| 974 | GACAG | ATAGAGGGGCTGGAACTCCGT | 24572 | SauCas9KKH | 85 | 0 |
| 975 | GACAGT | ATAGAGGGGCTGGAACTCCGT | 24573 | SauCas9KKH | 85 | 0 |
| 976 | GACAGT | ATAGAGGGGCTGGAACTCCGT | 24574 | cCas9-v17 | 85 | 0 |
| 977 | GACAGT | ATAGAGGGGCTGGAACTCCGT | 24575 | cCas9-v42 | 85 | 0 |
| 978 | ATG | GTAGAAGGAATCGGGGTGAG | 24576 | ScaCas9 | 85 | 0 |
| 979 | ATG | GTAGAAGGAATCGGGGTGAG | 24577 | ScaCas9-HiFi-Sc++ | 85 | 0 |
| 980 | ATG | GTAGAAGGAATCGGGGTGAG | 24578 | ScaCas9-Sc++ | 85 | 0 |
| 981 | ATG | GTAGAAGGAATCGGGGTGAG | 24579 | SpyCas9-SpRY | 85 | 0 |
| 982 | GAC | TAGAGGGGCTGGAACTCCGT | 24580 | SpyCas9-SpRY | 85 | 0 |
| 983 | ATGAGA | TGTAGAAGGAATCGGGGTGAG | 24581 | cCas9-v17 | 85 | 0 |
| 984 | ATGAGA | TGTAGAAGGAATCGGGGTGAG | 24582 | cCas9-v42 | 85 | 0 |
| 985 | GACA | TAGAGGGGCTGGAACTCCGT | 24583 | SpyCas9-3var-NRCH | 85 | 0 |
| 986 | GATGA | ATGTAGAAGGAATCGGGGTGA | 24584 | SauCas9KKH | 86 | 0 |
| 987 | TG | ATAGAGGGGCTGGAACTCCG | 24585 | SpyCas9-NG | 86 | 0 |
| 988 | TG | ATAGAGGGGCTGGAACTCCG | 24586 | SpyCas9-xCas | 86 | 0 |
| 989 | TG | ATAGAGGGGCTGGAACTCCG | 24587 | SpyCas9-xCas-NG | 86 | 0 |
| 990 | TGA | ATAGAGGGGCTGGAACTCCG | 24588 | SpyCas9-SpG | 86 | 0 |
| 991 | TGA | ATAGAGGGGCTGGAACTCCG | 24589 | SpyCas9-SpRY | 86 | 0 |

TABLE 1D-continued

Exemplary gRNA spacer Cas pairs for correcting the pathogenic IVS10-11G > A mutation Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 992 | GAT | TGTAGAAGGAATCGGGGTGA | 24590 | SpyCas9-SpRY | 86 | 0 |
| 993 | GAT | TGTAGAAGGAATCGGGGTGA | 24591 | SpyCas9-xCas | 86 | 0 |
| 994 | TGAC | ATAGAGGGGCTGGAACTCCG | 24592 | SpyCas9-3var-NRRH | 86 | 0 |
| 995 | TGAC | ATAGAGGGGCTGGAACTCCG | 24593 | SpyCas9-VQR | 86 | 0 |
| 996 | GTG | AATAGAGGGGCTGGAACTCC | 24594 | ScaCas9 | 87 | 0 |
| 997 | GTG | AATAGAGGGGCTGGAACTCC | 24595 | ScaCas9-HiFi-Sc++ | 87 | 0 |
| 998 | GTG | AATAGAGGGGCTGGAACTCC | 24596 | ScaCas9-Sc++ | 87 | 0 |
| 999 | GTG | AATAGAGGGGCTGGAACTCC | 24597 | SpyCas9-SpRY | 87 | 0 |
| 1000 | AG | ATGTAGAAGGAATCGGGGTG | 24598 | SpyCas9-NG | 87 | 0 |
| 1001 | AG | ATGTAGAAGGAATCGGGGTG | 24599 | SpyCas9-xCas | 87 | 0 |
| 1002 | AG | ATGTAGAAGGAATCGGGGTG | 24600 | SpyCas9-xCas-NG | 87 | 0 |
| 1003 | AGA | ATGTAGAAGGAATCGGGGTG | 24601 | SpyCas9-SpG | 87 | 0 |
| 1004 | AGA | ATGTAGAAGGAATCGGGGTG | 24602 | SpyCas9-SpRY | 87 | 0 |
| 1005 | GTGACAGT | cgtaATAGAGGGGCTGGAACTCC | 24603 | BlatCas9 | 87 | 0 |
| 1006 | GTGAC | cgtaATAGAGGGGCTGGAACTCC | 24604 | BlatCas9 | 87 | 0 |
| 1007 | AGAT | ATGTAGAAGGAATCGGGGTG | 24605 | SpyCas9-3var-NRRH | 87 | 0 |
| 1008 | AGAT | ATGTAGAAGGAATCGGGGTG | 24606 | SpyCas9-VQR | 87 | 0 |
| 1009 | CGTGA | GTAATAGAGGGGCTGGAACTC | 24607 | SauCas9KKH | 88 | 0 |
| 1010 | GAG | GATGTAGAAGGAATCGGGGT | 24608 | ScaCas9 | 88 | 0 |
| 1011 | GAG | GATGTAGAAGGAATCGGGGT | 24609 | ScaCas9-HiFi-Sc++ | 88 | 0 |
| 1012 | GAG | GATGTAGAAGGAATCGGGGT | 24610 | ScaCas9-Sc++ | 88 | 0 |
| 1013 | GAG | GATGTAGAAGGAATCGGGGT | 24611 | SpyCas9-SpRY | 88 | 0 |
| 1014 | CG | TAATAGAGGGGCTGGAACTC | 24612 | SpyCas9-NG | 88 | 0 |
| 1015 | CG | TAATAGAGGGGCTGGAACTC | 24613 | SpyCas9-xCas | 88 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 1016 | CG | TAATAGAGGGGCTGGAACTC | 24614 | SpyCas9-xCas-NG | 88 | 0 |
| 1017 | CGT | TAATAGAGGGGCTGGAACTC | 24615 | SpyCas9-SpG | 88 | 0 |
| 1018 | CGT | TAATAGAGGGGCTGGAACTC | 24616 | SpyCas9-SpRY | 88 | 0 |
| 1019 | GAGATGA | TGATGTAGAAGGAATCGGGGT | 24617 | cCas9-v16 | 88 | 0 |
| 1020 | GAGATGA | TGATGTAGAAGGAATCGGGGT | 24618 | cCas9-v21 | 88 | 0 |
| 1021 | GAGA | GATGTAGAAGGAATCGGGGT | 24619 | SpyCas9-3var-NRRH | 88 | 0 |
| 1022 | TGAGA | GTGATGTAGAAGGAATCGGGG | 24620 | SauCas9KKH | 89 | 0 |
| 1023 | TGAGAT | GTGATGTAGAAGGAATCGGGG | 24621 | SauCas9KKH | 89 | 0 |
| 1024 | TGAGAT | GTGATGTAGAAGGAATCGGGG | 24622 | cCas9-v17 | 89 | 0 |
| 1025 | TGAGAT | GTGATGTAGAAGGAATCGGGG | 24623 | cCas9-v42 | 89 | 0 |
| 1026 | TGAG | GTGATGTAGAAGGAATCGGGG | 24624 | SauriCas9-KKH | 89 | 0 |
| 1027 | TGAG | TGATGTAGAAGGAATCGGGG | 24625 | SpyCas9-VQR | 89 | 0 |
| 1028 | CCG | GTAATAGAGGGGCTGGAACT | 24626 | ScaCas9 | 89 | 0 |
| 1029 | CCG | GTAATAGAGGGGCTGGAACT | 24627 | ScaCas9-HiFi-Sc++ | 89 | 0 |
| 1030 | CCG | GTAATAGAGGGGCTGGAACT | 24628 | ScaCas9-Sc++ | 89 | 0 |
| 1031 | CCG | GTAATAGAGGGGCTGGAACT | 24629 | SpyCas9-SpRY | 89 | 0 |
| 1032 | TG | TGATGTAGAAGGAATCGGGG | 24630 | SpyCas9-NG | 89 | 0 |
| 1033 | TG | TGATGTAGAAGGAATCGGGG | 24631 | SpyCas9-xCas | 89 | 0 |
| 1034 | TG | TGATGTAGAAGGAATCGGGG | 24632 | SpyCas9-xCas-NG | 89 | 0 |
| 1035 | TGA | TGATGTAGAAGGAATCGGGG | 24633 | SpyCas9-SpG | 89 | 0 |
| 1036 | TGA | TGATGTAGAAGGAATCGGGG | 24634 | SpyCas9-SpRY | 89 | 0 |
| 1037 | CCGTGACA | ccacGTAATAGAGGGGCTGGAACT | 24635 | NmeCas9 | 89 | 0 |
| 1038 | GTGAG | gcTGTGATGTAGAAGGAATCGGG | 24636 | SauCas9 | 90 | 0 |
| 1039 | GTGAG | TGTGATGTAGAAGGAATCGGG | 24637 | SauCas9KKH | 90 | 0 |
| 1040 | GTG | GTGATGTAGAAGGAATCGGG | 24638 | ScaCas9 | 90 | 0 |
| 1041 | GTG | GTGATGTAGAAGGAATCGGG | 24639 | ScaCas9-HiFi-Sc++ | 90 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 1042 | GTG | GTGATGTAGAAGGAATCGGG | 24640 | ScaCas9-Sc++ | 90 | 0 |
| 1043 | GTG | GTGATGTAGAAGGAATCGGG | 24641 | SpyCas9-SpRY | 90 | 0 |
| 1044 | TCC | CGTAATAGAGGGGCTGGAAC | 24642 | SpyCas9-SpRY | 90 | 0 |
| 1045 | TCCGTG | ACGTAATAGAGGGGCTGGAAC | 24643 | cCas9-v16 | 90 | 0 |
| 1046 | TCCGTG | ACGTAATAGAGGGGCTGGAAC | 24644 | cCas9-v21 | 90 | 0 |
| 1047 | GTGAGA | TGTGATGTAGAAGGAATCGGG | 24645 | cCas9-v17 | 90 | 0 |
| 1048 | GTGAGA | TGTGATGTAGAAGGAATCGGG | 24646 | cCas9-v42 | 90 | 0 |
| 1049 | GGTGA | CTGTGATGTAGAAGGAATCGG | 24647 | SauCas9KKH | 91 | 0 |
| 1050 | GG | TGTGATGTAGAAGGAATCGG | 24648 | SpyCas9-NG | 91 | 0 |
| 1051 | GG | TGTGATGTAGAAGGAATCGG | 24649 | SpyCas9-xCas | 91 | 0 |
| 1052 | GG | TGTGATGTAGAAGGAATCGG | 24650 | SpyCas9-xCas-NG | 91 | 0 |
| 1053 | GGT | TGTGATGTAGAAGGAATCGG | 24651 | SpyCas9-SpG | 91 | 0 |
| 1054 | GGT | TGTGATGTAGAAGGAATCGG | 24652 | SpyCas9-SpRY | 91 | 0 |
| 1055 | CTC | ACGTAATAGAGGGGCTGGAA | 24653 | SpyCas9-SpRY | 91 | 0 |
| 1056 | GGG | CTGTGATGTAGAAGGAATCG | 24654 | ScaCas9 | 92 | 0 |
| 1057 | GGG | CTGTGATGTAGAAGGAATCG | 24655 | ScaCas9-HiFi-Sc++ | 92 | 0 |
| 1058 | GGG | CTGTGATGTAGAAGGAATCG | 24656 | ScaCas9-Sc++ | 92 | 0 |
| 1059 | GGG | CTGTGATGTAGAAGGAATCG | 24657 | SpyCas9 | 92 | 0 |
| 1060 | GGG | CTGTGATGTAGAAGGAATCG | 24658 | SpyCas9-HF1 | 92 | 0 |
| 1061 | GGG | CTGTGATGTAGAAGGAATCG | 24659 | SpyCas9-SpG | 92 | 0 |
| 1062 | GGG | CTGTGATGTAGAAGGAATCG | 24660 | SpyCas9-SpRY | 92 | 0 |
| 1063 | GG | CTGTGATGTAGAAGGAATCG | 24661 | SpyCas9-NG | 92 | 0 |
| 1064 | GG | CTGTGATGTAGAAGGAATCG | 24662 | SpyCas9-xCas | 92 | 0 |
| 1065 | GG | CTGTGATGTAGAAGGAATCG | 24663 | SpyCas9-xCas-NG | 92 | 0 |
| 1066 | ACT | CACGTAATAGAGGGGCTGGA | 24664 | SpyCas9-SpRY | 92 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 1067 | ACTCCGTG | tgccACGTAATAGAGGGGCTGGA | 24665 | BlatCas9 | 92 | 0 |
| 1068 | ACTCC | tgccACGTAATAGAGGGGCTGGA | 24666 | BlatCas9 | 92 | 0 |
| 1069 | GGGT | CTGTGATGTAGAAGGAATCG | 24667 | SpyCas9-3var-NRRH | 92 | 0 |
| 1070 | AACTCC | tcTGCCACGTAATAGAGGGGCTGG | 24668 | Nme2Cas9 | 93 | 0 |
| 1071 | GGGG | GGCTGTGATGTAGAAGGAATC | 24669 | SauriCas9 | 93 | 0 |
| 1072 | GGGG | GGCTGTGATGTAGAAGGAATC | 24670 | SauriCas9-KKH | 93 | 0 |
| 1073 | GGG | GCTGTGATGTAGAAGGAATC | 24671 | ScaCas9 | 93 | 0 |
| 1074 | GGG | GCTGTGATGTAGAAGGAATC | 24672 | ScaCas9-HiFi-Sc++ | 93 | 0 |
| 1075 | GGG | GCTGTGATGTAGAAGGAATC | 24673 | ScaCas9-Sc++ | 93 | 0 |
| 1076 | GGG | GCTGTGATGTAGAAGGAATC | 24674 | SpyCas9 | 93 | 0 |
| 1077 | GGG | GCTGTGATGTAGAAGGAATC | 24675 | SpyCas9-HF1 | 93 | 0 |
| 1078 | GGG | GCTGTGATGTAGAAGGAATC | 24676 | SpyCas9-SpG | 93 | 0 |
| 1079 | GGG | GCTGTGATGTAGAAGGAATC | 24677 | SpyCas9-SpRY | 93 | 0 |
| 1080 | GG | GCTGTGATGTAGAAGGAATC | 24678 | SpyCas9-NG | 93 | 0 |
| 1081 | GG | GCTGTGATGTAGAAGGAATC | 24679 | SpyCas9-xCas | 93 | 0 |
| 1082 | GG | GCTGTGATGTAGAAGGAATC | 24680 | SpyCas9-xCas-NG | 93 | 0 |
| 1083 | AAC | CCACGTAATAGAGGGGCTGG | 24681 | SpyCas9-SpRY | 93 | 0 |
| 1084 | AACTCCGT | ctgcCACGTAATAGAGGGGCTGG | 24682 | BlatCas9 | 93 | 0 |
| 1085 | AACTC | ctgcCACGTAATAGAGGGGCTGG | 24683 | BlatCas9 | 93 | 0 |
| 1086 | GGGGTG | GGCTGTGATGTAGAAGGAATC | 24684 | cCas9-v16 | 93 | 0 |
| 1087 | GGGGTG | GGCTGTGATGTAGAAGGAATC | 24685 | cCas9-v21 | 93 | 0 |
| 1088 | AACT | CCACGTAATAGAGGGGCTGG | 24686 | SpyCas9-3var-NRCH | 93 | 0 |
| 1089 | CGGGG | ttGGGCTGTGATGTAGAAGGAAT | 24687 | SauCas9 | 94 | 0 |
| 1090 | CGGGG | GGGCTGTGATGTAGAAGGAAT | 24688 | SauCas9KKH | 94 | 0 |
| 1091 | CGGGGT | ttGGGCTGTGATGTAGAAGGAAT | 24689 | SauCas9 | 94 | 0 |
| 1092 | CGGGGT | GGGCTGTGATGTAGAAGGAAT | 24690 | SauCas9KKH | 94 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 1093 | CGGGGT | GGGCTGTGATGTAGAAGGAAT | 24691 | cCas9-v17 | 94 | 0 |
| 1094 | CGGGGT | GGGCTGTGATGTAGAAGGAAT | 24692 | cCas9-v42 | 94 | 0 |
| 1095 | CGGG | GGGCTGTGATGTAGAAGGAAT | 24693 | SauriCas9 | 94 | 0 |
| 1096 | CGGG | GGGCTGTGATGTAGAAGGAAT | 24694 | SauriCas9-KKH | 94 | 0 |
| 1097 | CGG | GGCTGTGATGTAGAAGGAAT | 24695 | ScaCas9 | 94 | 0 |
| 1098 | CGG | GGCTGTGATGTAGAAGGAAT | 24696 | ScaCas9-HiFi-Sc++ | 94 | 0 |
| 1099 | CGG | GGCTGTGATGTAGAAGGAAT | 24697 | ScaCas9-Sc++ | 94 | 0 |
| 1100 | CGG | GGCTGTGATGTAGAAGGAAT | 24698 | SpyCas9 | 94 | 0 |
| 1101 | CGG | GGCTGTGATGTAGAAGGAAT | 24699 | SpyCas9-HF1 | 94 | 0 |
| 1102 | CGG | GGCTGTGATGTAGAAGGAAT | 24700 | SpyCas9-SpG | 94 | 0 |
| 1103 | CGG | GGCTGTGATGTAGAAGGAAT | 24701 | SpyCas9-SpRY | 94 | 0 |
| 1104 | CG | GGCTGTGATGTAGAAGGAAT | 24702 | SpyCas9-NG | 94 | 0 |
| 1105 | CG | GGCTGTGATGTAGAAGGAAT | 24703 | SpyCas9-xCas | 94 | 0 |
| 1106 | CG | GGCTGTGATGTAGAAGGAAT | 24704 | SpyCas9-xCas-NG | 94 | 0 |
| 1107 | GAA | GCCACGTAATAGAGGGGCTG | 24705 | SpyCas9-SpRY | 94 | 0 |
| 1108 | GAA | GCCACGTAATAGAGGGGCTG | 24706 | SpyCas9-xCas | 94 | 0 |
| 1109 | GAACTCC | CTGCCACGTAATAGAGGGGCTG | 24707 | CdiCas9 | 94 | 0 |
| 1110 | GAAC | GCCACGTAATAGAGGGGCTG | 24708 | SpyCas9-3var-NRRH | 94 | 0 |
| 1111 | GAAC | tgCCACGTAATAGAGGGGCTG | 24709 | iSpyMacCas9 | 94 | 0 |
| 1112 | TCGGG | ttTGGGCTGTGATGTAGAAGGAA | 24710 | SauCas9 | 95 | 0 |
| 1113 | TCGGG | TGGGCTGTGATGTAGAAGGAA | 24711 | SauCas9KKH | 95 | 0 |
| 1114 | TCGG | TGGGCTGTGATGTAGAAGGAA | 24712 | SauriCas9 | 95 | 0 |
| 1115 | TCGG | TGGGCTGTGATGTAGAAGGAA | 24713 | SauriCas9-KKH | 95 | 0 |
| 1116 | TCG | GGGCTGTGATGTAGAAGGAA | 24714 | ScaCas9 | 95 | 0 |
| 1117 | TCG | GGGCTGTGATGTAGAAGGAA | 24715 | ScaCas9-HiFi-Sc++ | 95 | 0 |
| 1118 | TCG | GGGCTGTGATGTAGAAGGAA | 24716 | ScaCas9-Sc++ | 95 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 1119 | TCG | GGGCTGTGATGTAGAAGGAA | 24717 | SpyCas9-SpRY | 95 | 0 |
| 1120 | GG | TGCCACGTAATAGAGGGGCT | 24718 | SpyCas9-NG | 95 | 0 |
| 1121 | GG | TGCCACGTAATAGAGGGGCT | 24719 | SpyCas9-xCas | 95 | 0 |
| 1122 | GG | TGCCACGTAATAGAGGGGCT | 24720 | SpyCas9-xCas-NG | 95 | 0 |
| 1123 | GGA | TGCCACGTAATAGAGGGGCT | 24721 | SpyCas9-SpG | 95 | 0 |
| 1124 | GGA | TGCCACGTAATAGAGGGGCT | 24722 | SpyCas9-SpRY | 95 | 0 |
| 1125 | GGAAC | ctctGCCACGTAATAGAGGGGCT | 24723 | BlatCas9 | 95 | 0 |
| 1126 | GGAACT | CTGCCACGTAATAGAGGGGCT | 24724 | cCas9-v16 | 95 | 0 |
| 1127 | GGAACT | CTGCCACGTAATAGAGGGGCT | 24725 | cCas9-v21 | 95 | 0 |
| 1128 | TCGGGG | TGGGCTGTGATGTAGAAGGAA | 24726 | cCas9-v17 | 95 | 0 |
| 1129 | TCGGGG | TGGGCTGTGATGTAGAAGGAA | 24727 | cCas9-v42 | 95 | 0 |
| 1130 | GGAACTC | TCTGCCACGTAATAGAGGGGCT | 24728 | CdiCas9 | 95 | 0 |
| 1131 | GGAA | TGCCACGTAATAGAGGGGCT | 24729 | SpyCas9-3var-NRRH | 95 | 0 |
| 1132 | GGAA | TGCCACGTAATAGAGGGGCT | 24730 | SpyCas9-VQR | 95 | 0 |
| 1133 | TGGAA | tcTCTGCCACGTAATAGAGGGGC | 24731 | SauCas9 | 96 | 0 |
| 1134 | TGGAA | TCTGCCACGTAATAGAGGGGC | 24732 | SauCas9KKH | 96 | 0 |
| 1135 | ATCGG | TTGGGCTGTGATGTAGAAGGA | 24733 | SauCas9KKH | 96 | 0 |
| 1136 | TGG | CTGCCACGTAATAGAGGGGC | 24734 | ScaCas9 | 96 | 0 |
| 1137 | TGG | CTGCCACGTAATAGAGGGGC | 24735 | ScaCas9-HiFi-Sc++ | 96 | 0 |
| 1138 | TGG | CTGCCACGTAATAGAGGGGC | 24736 | ScaCas9-Sc++ | 96 | 0 |
| 1139 | TGG | CTGCCACGTAATAGAGGGGC | 24737 | SpyCas9 | 96 | 0 |
| 1140 | TGG | CTGCCACGTAATAGAGGGGC | 24738 | SpyCas9-HF1 | 96 | 0 |
| 1141 | TGG | CTGCCACGTAATAGAGGGGC | 24739 | SpyCas9-SpG | 96 | 0 |
| 1142 | TGG | CTGCCACGTAATAGAGGGGC | 24740 | SpyCas9-SpRY | 96 | 0 |
| 1143 | TG | CTGCCACGTAATAGAGGGGC | 24741 | SpyCas9-NG | 96 | 0 |
| 1144 | TG | CTGCCACGTAATAGAGGGGC | 24742 | SpyCas9-xCas | 96 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 1145 | TG | CTGCCACGTAATAGAGGGGC | 24743 | SpyCas9-xCas-NG | 96 | 0 |
| 1146 | ATC | TGGGCTGTGATGTAGAAGGA | 24744 | SpyCas9-SpRY | 96 | 0 |
| 1147 | TGGAAC | TCTGCCACGTAATAGAGGGGC | 24745 | cCas9-v17 | 96 | 0 |
| 1148 | TGGAAC | TCTGCCACGTAATAGAGGGGC | 24746 | cCas9-v42 | 96 | 0 |
| 1149 | ATCGGG | TTGGGCTGTGATGTAGAAGGA | 24747 | cCas9-v17 | 96 | 0 |
| 1150 | ATCGGG | TTGGGCTGTGATGTAGAAGGA | 24748 | cCas9-v42 | 96 | 0 |
| 1151 | TGGAACT | CTCTGCCACGTAATAGAGGGGC | 24749 | CdiCas9 | 96 | 0 |
| 1152 | TGGA | CTGCCACGTAATAGAGGGGC | 24750 | SpyCas9-3var-NRRH | 96 | 0 |
| 1153 | CTGGA | ctCTCTGCCACGTAATAGAGGGG | 24751 | SauCas9 | 97 | 0 |
| 1154 | CTGGA | CTCTGCCACGTAATAGAGGGG | 24752 | SauCas9KKH | 97 | 0 |
| 1155 | CTGG | CTCTGCCACGTAATAGAGGGG | 24753 | SauriCas9 | 97 | 0 |
| 1156 | CTGG | CTCTGCCACGTAATAGAGGGG | 24754 | SauriCas9-KKH | 97 | 0 |
| 1157 | CTG | TCTGCCACGTAATAGAGGGG | 24755 | ScaCas9 | 97 | 0 |
| 1158 | CTG | TCTGCCACGTAATAGAGGGG | 24756 | ScaCas9-HiFi-Sc++ | 97 | 0 |
| 1159 | CTG | TCTGCCACGTAATAGAGGGG | 24757 | ScaCas9-Sc++ | 97 | 0 |
| 1160 | CTG | TCTGCCACGTAATAGAGGGG | 24758 | SpyCas9-SpRY | 97 | 0 |
| 1161 | AAT | TTGGGCTGTGATGTAGAAGG | 24759 | SpyCas9-SpRY | 97 | 0 |
| 1162 | CTGGAA | CTCTGCCACGTAATAGAGGGG | 24760 | cCas9-v17 | 97 | 0 |
| 1163 | CTGGAA | CTCTGCCACGTAATAGAGGGG | 24761 | cCas9-v42 | 97 | 0 |
| 1164 | AATC | TTGGGCTGTGATGTAGAAGG | 24762 | SpyCas9-3var-NRTH | 97 | 0 |
| 1165 | GCTGG | TCTCTGCCACGTAATAGAGGG | 24763 | SauCas9KKH | 98 | 0 |
| 1166 | GAA | TTTGGGCTGTGATGTAGAAG | 24764 | SpyCas9-SpRY | 98 | 0 |
| 1167 | GAA | TTTGGGCTGTGATGTAGAAG | 24765 | SpyCas9-xCas | 98 | 0 |
| 1168 | GCT | CTCTGCCACGTAATAGAGGG | 24766 | SpyCas9-SpRY | 98 | 0 |
| 1169 | GAATCGG G | gcatTTGGGCTGTGATGTAGAAG | 24767 | BlatCas9 | 98 | 0 |
| 1170 | GAATC | gcatTTGGGCTGTGATGTAGAAG | 24768 | BlatCas9 | 98 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 1171 | GAAT | TTTGGGCTGTGATGTAGAAG | 24769 | SpyCas9-3var-NRRH | 98 | 0 |
| 1172 | GAAT | atTTGGGCTGTGATGTAGAAG | 24770 | iSpyMacCas9 | 98 | 0 |
| 1173 | GG | TCTCTGCCACGTAATAGAGG | 24771 | SpyCas9-NG | 99 | 0 |
| 1174 | GG | TCTCTGCCACGTAATAGAGG | 24772 | SpyCas9-xCas | 99 | 0 |
| 1175 | GG | TCTCTGCCACGTAATAGAGG | 24773 | SpyCas9-xCas-NG | 99 | 0 |
| 1176 | GG | ATTTGGGCTGTGATGTAGAA | 24774 | SpyCas9-NG | 99 | 0 |
| 1177 | GG | ATTTGGGCTGTGATGTAGAA | 24775 | SpyCas9-xCas | 99 | 0 |
| 1178 | GG | ATTTGGGCTGTGATGTAGAA | 24776 | SpyCas9-xCas-NG | 99 | 0 |
| 1179 | GGC | TCTCTGCCACGTAATAGAGG | 24777 | SpyCas9-SpG | 99 | 0 |
| 1180 | GGC | TCTCTGCCACGTAATAGAGG | 24778 | SpyCas9-SpRY | 99 | 0 |
| 1181 | GGA | ATTTGGGCTGTGATGTAGAA | 24779 | SpyCas9-SpG | 99 | 0 |
| 1182 | GGA | ATTTGGGCTGTGATGTAGAA | 24780 | SpyCas9-SpRY | 99 | 0 |
| 1183 | GGAA | ATTTGGGCTGTGATGTAGAA | 24781 | SpyCas9-3var-NRRH | 99 | 0 |
| 1184 | GGAA | ATTTGGGCTGTGATGTAGAA | 24782 | SpyCas9-VQR | 99 | 0 |
| 1185 | GGCT | TCTCTGCCACGTAATAGAGG | 24783 | SpyCas9-3var-NRCH | 99 | 0 |
| 1186 | AGGAA | caGCATTTGGGCTGTGATGTAGA | 24784 | SauCas9 | 100 | 0 |
| 1187 | AGGAA | GCATTTGGGCTGTGATGTAGA | 24785 | SauCas9KKH | 100 | 0 |
| 1188 | AGGAAT | caGCATTTGGGCTGTGATGTAGA | 24786 | SauCas9 | 100 | 0 |
| 1189 | AGGAAT | GCATTTGGGCTGTGATGTAGA | 24787 | SauCas9KKH | 100 | 0 |
| 1190 | AGGAAT | GCATTTGGGCTGTGATGTAGA | 24788 | cCas9-v17 | 100 | 0 |
| 1191 | AGGAAT | GCATTTGGGCTGTGATGTAGA | 24789 | cCas9-v42 | 100 | 0 |
| 1192 | GGG | CTCTCTGCCACGTAATAGAG | 24790 | ScaCas9 | 100 | 0 |
| 1193 | GGG | CTCTCTGCCACGTAATAGAG | 24791 | ScaCas9-HiFi-Sc++ | 100 | 0 |
| 1194 | GGG | CTCTCTGCCACGTAATAGAG | 24792 | ScaCas9-Sc++ | 100 | 0 |
| 1195 | GGG | CTCTCTGCCACGTAATAGAG | 24793 | SpyCas9 | 100 | 0 |
| 1196 | GGG | CTCTCTGCCACGTAATAGAG | 24794 | SpyCas9-HF1 | 100 | 0 |

TABLE 1D-continued

Exemplary gRNA spacer Cas pairs for correcting the pathogenic IVS10-11G > A mutation
Table 1D provides a gRNA database for correcting the pathogenic IVS10-11G > A mutation in PAH. List of spacers, PAMs, and Cas variants for generating a nick at an appropriate position to enable installation of a desired genomic edit with a gene modifying system. The spacers in this table are designed to be used with a gene modifying polypeptide comprising a nickase variant of the Cas species indicated in the table. Tables 2D, 3D, and 4D detail the other components of the system and are organized such that the ID number shown here in Column 1 ("ID") is meant to correspond to the same ID number in Tables 2D, 2D, and 4D.

| ID | PAM sequence | gRNA spacer | SEQ ID NO | Cas species | distance | Overlaps mutation |
|---|---|---|---|---|---|---|
| 1197 | GGG | CTCTCTGCCACGTAATAGAG | 24795 | SpyCas9-SpG | 100 | 0 |
| 1198 | GGG | CTCTCTGCCACGTAATAGAG | 24796 | SpyCas9-SpRY | 100 | 0 |
| 1199 | AGG | CATTTGGGCTGTGATGTAGA | 24797 | ScaCas9 | 100 | 0 |
| 1200 | AGG | CATTTGGGCTGTGATGTAGA | 24798 | ScaCas9-HiFi-Sc++ | 100 | 0 |
| 1201 | AGG | CATTTGGGCTGTGATGTAGA | 24799 | ScaCas9-Sc++ | 100 | 0 |
| 1202 | AGG | CATTTGGGCTGTGATGTAGA | 24800 | SpyCas9 | 100 | 0 |
| 1203 | AGG | CATTTGGGCTGTGATGTAGA | 24801 | SpyCas9-HF1 | 100 | 0 |
| 1204 | AGG | CATTTGGGCTGTGATGTAGA | 24802 | SpyCas9-SpG | 100 | 0 |
| 1205 | AGG | CATTTGGGCTGTGATGTAGA | 24803 | SpyCas9-SpRY | 100 | 0 |
| 1206 | GG | CTCTCTGCCACGTAATAGAG | 24804 | SpyCas9-NG | 100 | 0 |
| 1207 | GG | CTCTCTGCCACGTAATAGAG | 24805 | SpyCas9-xCas | 100 | 0 |
| 1208 | GG | CTCTCTGCCACGTAATAGAG | 24806 | SpyCas9-xCas-NG | 100 | 0 |
| 1209 | AG | CATTTGGGCTGTGATGTAGA | 24807 | SpyCas9-NG | 100 | 0 |
| 1210 | AG | CATTTGGGCTGTGATGTAGA | 24808 | SpyCas9-xCas | 100 | 0 |
| 1211 | AG | CATTTGGGCTGTGATGTAGA | 24809 | SpyCas9-xCas-NG | 100 | 0 |
| 1212 | AGGAATC | AGCATTTGGGCTGTGATGTAGA | 24810 | CdiCas9 | 100 | 0 |
| 1213 | GGGC | CTCTCTGCCACGTAATAGAG | 24811 | SpyCas9-3var-NRRH | 100 | 0 |
| 1214 | AGGA | CATTTGGGCTGTGATGTAGA | 24812 | SpyCas9-3var-NRRH | 100 | 0 |

In the exemplary template sequences provided herein, capital letters indicate "core nucleotides" while lower case letters indicate "flanking nucleotides." Herein, when an RNA sequence (e.g., a template RNA sequence) is said to comprise a particular sequence (e.g., a sequence of Tables 1A, 1B, 1C, or 1D or a portion thereof) that comprises thymine (T), it is of course understood that the RNA sequence may (and frequently does) comprise uracil (U) in place of T. For instance, the RNA sequence may comprise U at every position shown as T in the sequence in Tables 1A, 1B, 1C, or 1D. More specifically, the present disclosure provides an RNA sequence according to every gRNA spacer sequence shown in Tables 1A, 1B, 1C, or 1D, wherein the RNA sequence has a U in place of each T in the sequence in Tables 1A, 1B, 1C, or 1D.

In some embodiments of the systems and methods herein, the heterologous object sequence comprises the core nucleotides of an RT template sequence from Table 3A, Table 3B, Table 3C, or Table 3D. In some embodiments, the heterologous object sequence additionally comprises one or more (e.g., 2, 3, 4, 5, 10, 20, 30, 40, or all) consecutive nucleotides starting with the 3' end of the flanking nucleotides of the RT template sequence. In some embodiments, the heterologous object sequence comprises the core nucleotides of the RT template sequence of Table 3A, Table 3B, Table 3C, or Table 3D that corresponds to the gRNA spacer sequence. In the context of the sequence tables, a first component "corresponds to" a second component when both components have the same ID number in the referenced table. For example, for a gRNA spacer of ID #1, the corresponding RT template would be the RT template also having ID #1 in a table referencing the same mutation. In some embodiments, the heterologous object sequence additionally comprises one or more consecutive nucleotides starting with the 3' end of the flanking nucleotides of the RT template sequence.

In some embodiments, the primer binding site (PBS) sequence has a sequence comprising the core nucleotides of a PBS sequence from the same row of Table 3A, Table 3B, Table 3C, or Table 3D as the RT template sequence. In some embodiments, the PBS sequence additionally comprises one or more (e.g., 1, 2, 3, 4, 5, 6, 7, or all) consecutive nucleotides starting with the 5' end of the flanking nucleotides of the primer region.

TABLE 3A

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 1 | caagacctcaatcctttgggtgtatgggtcgtagcgaactgagaagggcCG | 24813 | AGGTATTGtg gcagcaa | 25003 |
| 2 | tcactcaagcctgtggttttggtcttaggaactttgctgccacaataccTCG | 24814 | GCCCTTCTca gttcgct | 25004 |
| 6 | tcactcaagcctgtggttttggtcttaggaactttgctgccacaataccTCG | 24815 | GCCCTTCTca gttcgct | 25005 |
| 7 | caagacctcaatcctttgggtgtatgggtcgtagcgaactgagaagggcCGA | 24816 | GGTATTGTgg cagcaaa | 25006 |
| 10 | tcactcaagcctgtggttttggtcttaggaactttgctgccacaataccTCGG | 24817 | CCCTTCTCag ttcgcta | 25007 |
| 13 | tcactcaagcctgtggttttggtcttaggaactttgctgccacaataccTCGG | 24818 | CCCTTCTCag ttcgcta | 25008 |
| 14 | tcactcaagcctgtggttttggtcttaggaactttgctgccacaataccTCGG | 24819 | CCCTTCTCag ttcgcta | 25009 |
| 17 | tcactcaagcctgtggttttggtcttaggaactttgctgccacaataccTCGG | 24820 | CCCTTCTCag ttcgcta | 25010 |
| 18 | caagacctcaatcctttgggtgtatgggtcgtagcgaactgagaagggcCGAG | 24821 | GTATTGTGgc agcaaag | 25011 |
| 21 | tcactcaagcctgtggttttggtcttaggaactttgctgccacaataccTCGG | 24822 | CCCTTCTCag ttcgcta | 25012 |
| 25 | caagacctcaatcctttgggtgtatgggtcgtagcgaactgagaagggcCGAG | 24823 | GTATTGTGgc agcaaag | 25013 |
| 26 | caagacctcaatcctttgggtgtatgggtcgtagcgaactgagaagggcCGAG | 24824 | GTATTGTGgc agcaaag | 25014 |
| 29 | caagacctcaatcctttgggtgtatgggtcgtagcgaactgagaagggcCGAGG | 24825 | TATTGTGGca gcaaagt | 25015 |
| 30 | tcactcaagcctgtggttttggtcttaggaactttgctgccacaataccTCGGC | 24826 | CCTTCTCAgtt cgctac | 25016 |
| 31 | tcactcaagcctgtggttttggtcttaggaactttgctgccacaataccTCGGC | 24827 | CCTTCTCAgtt cgctac | 25017 |
| 34 | caagacctcaatcctttgggtgtatgggtcgtagcgaactgagaagggcCGAGG | 24828 | TATTGTGGca gcaaagt | 25018 |

TABLE 3A-continued

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 35 | caagacctcaatcctttgggtgtatgggtcgtagcgaactgagaagggcCGAGG | 24829 | TATTGTGGca gcaaagt | 25019 |
| 38 | caagacctcaatcctttgggtgtatgggtcgtagcgaactgagaagggcCGAGG | 24830 | TATTGTGGca gcaaagt | 25020 |
| 41 | tcactcaagcctgtggttttggtcttaggaactttgctgccacaataccTCGGC | 24831 | CCTTCTCAgtt cgctac | 25021 |
| 42 | tcactcaagcctgtggttttggtcttaggaactttgctgccacaataccTCGGC | 24832 | CCTTCTCAgtt cgctac | 25022 |
| 43 | caagacctcaatcctttgggtgtatgggtcgtagcgaactgagaagggcCGAGG | 24833 | TATTGTGGca gcaaagt | 25023 |
| 46 | caagacctcaatcctttgggtgtatgggtcgtagcgaactgagaagggcCGAGG | 24834 | TATTGTGGca gcaaagt | 25024 |
| 47 | caagacctcaatcctttgggtgtatgggtcgtagcgaactgagaagggcCGAGG | 24835 | TATTGTGGca gcaaagt | 25025 |
| 50 | caagacctcaatcctttgggtgtatgggtcgtagcgaactgagaagggcCGAGGT | 24836 | ATTGTGGCag caaagtt | 25026 |
| 51 | tcactcaagcctgtggttttggtcttaggaactttgctgccacaataccTCGGCC | 24837 | CTTCTCAGttc gctacg | 25027 |
| 52 | tcactcaagcctgtggttttggtcttaggaactttgctgccacaataccTCGGCC | 24838 | CTTCTCAGttc gctacg | 25028 |
| 55 | caagacctcaatcctttgggtgtatgggtcgtagcgaactgagaagggcCGAGGT | 24839 | ATTGTGGCag caaagtt | 25029 |
| 56 | caagacctcaatcctttgggtgtatgggtcgtagcgaactgagaagggcCGAGGT | 24840 | ATTGTGGCag caaagtt | 25030 |
| 57 | tcactcaagcctgtggttttggtcttaggaactttgctgccacaataccTCGGCC | 24841 | CTTCTCAGttc gctacg | 25031 |
| 62 | caagacctcaatcctttgggtgtatgggtcgtagcgaactgagaagggcCGAGGT | 24842 | ATTGTGGCag caaagtt | 25032 |
| 63 | caagacctcaatcctttgggtgtatgggtcgtagcgaactgagaagggcCGAGGT | 24843 | ATTGTGGCag caaagtt | 25033 |
| 64 | tcactcaagcctgtggttttggtcttaggaactttgctgccacaataccTCGGCC | 24844 | CTTCTCAGttc gctacg | 25034 |
| 65 | caagacctcaatcctttgggtgtatgggtcgtagcgaactgagaagggcCGAGGT | 24845 | ATTGTGGCag caaagtt | 25035 |
| 66 | tcactcaagcctgtggttttggtcttaggaactttgctgccacaataccTCGGCCC | 24846 | TTCTCAGTtc gctacga | 25036 |
| 67 | caagacctcaatcctttgggtgtatgggtcgtagcgaactgagaagggcCGAGGTA | 24847 | TTGTGGCAgc aaagttc | 25037 |
| 68 | tcactcaagcctgtggttttggtcttaggaactttgctgccacaataccTCGGCCC | 24848 | TTCTCAGTtc gctacga | 25038 |

TABLE 3A-continued

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 69 | caagacctcaatcctttgggtgtatgggtcgtagcgaactgagaagggcCGAGGTA | 24849 | TTGTGGCAgcaaagttc | 25039 |
| 72 | tcactcaagcctgtggttttggtcttaggaactttgctgccacaataccTCGGCCCT | 24850 | TCTCAGTTcgctacgac | 25040 |
| 73 | tcactcaagcctgtggttttggtcttaggaactttgctgccacaataccTCGGCCCT | 24851 | TCTCAGTTcgctacgac | 25041 |
| 74 | caagacctcaatcctttgggtgtatgggtcgtagcgaactgagaagggcCGAGGTAT | 24852 | TGTGGCAGcaaagttcc | 25042 |
| 77 | tcactcaagcctgtggttttggtcttaggaactttgctgccacaataccTCGGCCCTT | 24853 | CTCAGTTCgctacgacc | 25043 |
| 81 | tcactcaagcctgtggttttggtcttaggaactttgctgccacaataccTCGGCCCTT | 24854 | CTCAGTTCgctacgacc | 25044 |
| 82 | caagacctcaatcctttgggtgtatgggtcgtagcgaactgagaagggcCGAGGTATT | 24855 | GTGGCAGCaaagttcct | 25045 |
| 86 | tcactcaagcctgtggttttggtcttaggaactttgctgccacaataccTCGGCCCTTC | 24856 | TCAGTTCGctacgaccc | 25046 |
| 87 | tcactcaagcctgtggttttggtcttaggaactttgctgccacaataccTCGGCCCTTC | 24857 | TCAGTTCGctacgaccc | 25047 |
| 90 | tcactcaagcctgtggttttggtcttaggaactttgctgccacaataccTCGGCCCTTC | 24858 | TCAGTTCGctacgaccc | 25048 |
| 91 | tcactcaagcctgtggttttggtcttaggaactttgctgccacaataccTCGGCCCTTC | 24859 | TCAGTTCGctacgaccc | 25049 |
| 94 | caagacctcaatcctttgggtgtatgggtcgtagcgaactgagaagggcCGAGGTATTG | 24860 | TGGCAGCAaagttccta | 25050 |
| 95 | tcactcaagcctgtggttttggtcttaggaactttgctgccacaataccTCGGCCCTTC | 24861 | TCAGTTCGctacgaccc | 25051 |
| 96 | tcactcaagcctgtggttttggtcttaggaactttgctgccacaataccTCGGCCCTTC | 24862 | TCAGTTCGctacgaccc | 25052 |
| 99 | tcactcaagcctgtggttttggtcttaggaactttgctgccacaataccTCGGCCCTTCT | 24863 | CAGTTCGCtacgaccca | 25053 |
| 100 | tcactcaagcctgtggttttggtcttaggaactttgctgccacaataccTCGGCCCTTCT | 24864 | CAGTTCGCtacgaccca | 25054 |
| 101 | tcactcaagcctgtggttttggtcttaggaactttgctgccacaataccTCGGCCCTTCT | 24865 | CAGTTCGCtacgaccca | 25055 |
| 104 | tcactcaagcctgtggttttggtcttaggaactttgctgccacaataccTCGGCCCTTCT | 24866 | CAGTTCGCtacgaccca | 25056 |
| 105 | tcactcaagcctgtggttttggtcttaggaactttgctgccacaataccTCGGCCCTTCT | 24867 | CAGTTCGCtacgaccca | 25057 |
| 108 | tcactcaagcctgtggttttggtcttaggaactttgctgccacaataccTCGGCCCTTCT | 24868 | CAGTTCGCtacgaccca | 25058 |
| 109 | tcactcaagcctgtggttttggtcttaggaactttgctgccacaataccTCGGCCCTTCT | 24869 | CAGTTCGCtacgaccca | 25059 |

TABLE 3A-continued

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 112 | caagacctcaatcctttgggtgtatgggtcgtagcgaactgagaagggcCGAGGTATTGT | 24870 | GGCAGCAAagttcctaa | 25060 |
| 113 | tcactcaagcctgtggttttggtcttaggaactttgctgccacaataccTCGGCCCTTCT | 24871 | CAGTTCGCtacgaccca | 25061 |
| 114 | tcactcaagcctgtggttttggtcttaggaactttgctgccacaataccTCGGCCCTTCT | 24872 | CAGTTCGCtacgaccca | 25062 |
| 115 | caagacctcaatcctttgggtgtatgggtcgtagcgaactgagaagggcCGAGGTATTGT | 24873 | GGCAGCAAagttcctaa | 25063 |
| 116 | tcactcaagcctgtggttttggtcttaggaactttgctgccacaataccTCGGCCCTTCT | 24874 | CAGTTCGCtacgaccca | 25064 |
| 117 | caagacctcaatcctttgggtgtatgggtcgtagcgaactgagaagggcCGAGGTATTGT | 24875 | GGCAGCAAagttcctaa | 25065 |
| 119 | caagacctcaatcctttgggtgtatgggtcgtagcgaactgagaagggcCGAGGTATTGTG | 24876 | GCAGCAAAgttcctaag | 25066 |
| 120 | tcactcaagcctgtggttttggtcttaggaactttgctgccacaataccTCGGCCCTTCTC | 24877 | AGTTCGCTacgacccat | 25067 |
| 121 | tcactcaagcctgtggttttggtcttaggaactttgctgccacaataccTCGGCCCTTCTC | 24878 | AGTTCGCTacgacccat | 25068 |
| 122 | tcactcaagcctgtggttttggtcttaggaactttgctgccacaataccTCGGCCCTTCTC | 24879 | AGTTCGCTacgacccat | 25069 |
| 123 | tcactcaagcctgtggttttggtcttaggaactttgctgccacaataccTCGGCCCTTCTC | 24880 | AGTTCGCTacgacccat | 25070 |
| 126 | tcactcaagcctgtggttttggtcttaggaactttgctgccacaataccTCGGCCCTTCTC | 24881 | AGTTCGCTacgacccat | 25071 |
| 127 | tcactcaagcctgtggttttggtcttaggaactttgctgccacaataccTCGGCCCTTCTC | 24882 | AGTTCGCTacgacccat | 25072 |
| 128 | caagacctcaatcctttgggtgtatgggtcgtagcgaactgagaagggcCGAGGTATTGTG | 24883 | GCAGCAAAgttcctaag | 25073 |
| 129 | caagacctcaatcctttgggtgtatgggtcgtagcgaactgagaagggcCGAGGTATTGTG | 24884 | GCAGCAAAgttcctaag | 25074 |
| 130 | caagacctcaatcctttgggtgtatgggtcgtagcgaactgagaagggcCGAGGTATTGTG | 24885 | GCAGCAAAgttcctaag | 25075 |
| 134 | tcactcaagcctgtggttttggtcttaggaactttgctgccacaataccTCGGCCCTTCTCA | 24886 | GTTCGCTAcgacccata | 25076 |
| 135 | tcactcaagcctgtggttttggtcttaggaactttgctgccacaataccTCGGCCCTTCTCA | 24887 | GTTCGCTAcgacccata | 25077 |
| 138 | tcactcaagcctgtggttttggtcttaggaactttgctgccacaataccTCGGCCCTTCTCA | 24888 | GTTCGCTAcgacccata | 25078 |
| 140 | caagacctcaatcctttgggtgtatgggtcgtagcgaactgagaagggcCGAGGTATTGTGG | 24889 | CAGCAAAGttcctaaga | 25079 |
| 146 | tcactcaagcctgtggttttggtcttaggaactttgctgccacaataccTCGGCCCTTCTCAG | 24890 | TTCGCTACgacccatac | 25080 |

TABLE 3A-continued

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 147 | tcactcaagcctgtggttttggtcttaggaactttgctgccacaataccTCGGCCCTTCTCAG | 24891 | TTCGCTACgacccatac | 25081 |
| 151 | tcactcaagcctgtggttttggtcttaggaactttgctgccacaataccTCGGCCCTTCTCAG | 24892 | TTCGCTACgacccatac | 25082 |
| 152 | caagacctcaatcctttgggtgtatgggtcgtagcgaactgagaagggcCGAGGTATTGTGGC | 24893 | AGCAAAGTtcctaagac | 25083 |
| 158 | tcactcaagcctgtggttttggtcttaggaactttgctgccacaataccTCGGCCCTTCTCAGT | 24894 | TCGCTACGacccataca | 25084 |
| 159 | tcactcaagcctgtggttttggtcttaggaactttgctgccacaataccTCGGCCCTTCTCAGT | 24895 | TCGCTACGacccataca | 25085 |
| 160 | caagacctcaatcctttgggtgtatgggtcgtagcgaactgagaagggcCGAGGTATTGTGGCA | 24896 | GCAAAGTTcctaagacc | 25086 |
| 161 | caagacctcaatcctttgggtgtatgggtcgtagcgaactgagaagggcCGAGGTATTGTGGCA | 24897 | GCAAAGTTcctaagacc | 25087 |
| 166 | tcactcaagcctgtggttttggtcttaggaactttgctgccacaataccTCGGCCCTTCTCAGT | 24898 | TCGCTACGacccataca | 25088 |
| 167 | tcactcaagcctgtggttttggtcttaggaactttgctgccacaataccTCGGCCCTTCTCAGT | 24899 | TCGCTACGacccataca | 25089 |
| 168 | caagacctcaatcctttgggtgtatgggtcgtagcgaactgagaagggcCGAGGTATTGTGGCA | 24900 | GCAAAGTTcctaagacc | 25090 |
| 174 | tcactcaagcctgtggttttggtcttaggaactttgctgccacaataccTCGGCCCTTCTCAGTT | 24901 | CGCTACGAcccatacac | 25091 |
| 175 | tcactcaagcctgtggttttggtcttaggaactttgctgccacaataccTCGGCCCTTCTCAGTT | 24902 | CGCTACGAcccatacac | 25092 |
| 177 | tcactcaagcctgtggttttggtcttaggaactttgctgccacaataccTCGGCCCTTCTCAGTT | 24903 | CGCTACGAcccatacac | 25093 |
| 181 | tcactcaagcctgtggttttggtcttaggaactttgctgccacaataccTCGGCCCTTCTCAGTT | 24904 | CGCTACGAcccatacac | 25094 |
| 182 | caagacctcaatcctttgggtgtatgggtcgtagcgaactgagaagggcCGAGGTATTGTGGCAG | 24905 | CAAAGTTCctaagacca | 25095 |
| 187 | tcactcaagcctgtggttttggtcttaggaactttgctgccacaataccTCGGCCCTTCTCAGTTC | 24906 | GCTACGACccatacacc | 25096 |
| 188 | tcactcaagcctgtggttttggtcttaggaactttgctgccacaataccTCGGCCCTTCTCAGTTC | 24907 | GCTACGACccatacacc | 25097 |
| 191 | tcactcaagcctgtggttttggtcttaggaactttgctgccacaataccTCGGCCCTTCTCAGTTC | 24908 | GCTACGACccatacacc | 25098 |
| 192 | tcactcaagcctgtggttttggtcttaggaactttgctgccacaataccTCGGCCCTTCTCAGTTC | 24909 | GCTACGACccatacacc | 25099 |
| 193 | caagacctcaatcctttgggtgtatgggtcgtagcgaactgagaagggcCGAGGTATTGTGGCAGC | 24910 | AAAGTTCCtaagaccaa | 25100 |
| 194 | caagacctcaatcctttgggtgtatgggtcgtagcgaactgagaagggcCGAGGTATTGTGGCAGC | 24911 | AAAGTTCCtaagaccaa | 25101 |

TABLE 3A-continued

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 195 | caagacctcaatcctttgggtgtatgggtcgtagcgaactgagaagggcCGAGGTATTG TGGCAGC | 24912 | AAAGTTCCta agaccaa | 25102 |
| 198 | tcactcaagcctgtggttttggtcttaggaactttgctgccacaataccTCGGCCCTTCTC AGTTCG | 24913 | CTACGACCca tacaccc | 25103 |
| 199 | caagacctcaatcctttgggtgtatgggtcgtagcgaactgagaagggcCGAGGTATTG TGGCAGCA | 24914 | AAGTTCCTaa gaccaaa | 25104 |
| 203 | caagacctcaatcctttgggtgtatgggtcgtagcgaactgagaagggcCGAGGTATTG TGGCAGCA | 24915 | AAGTTCCTaa gaccaaa | 25105 |
| 204 | tcactcaagcctgtggttttggtcttaggaactttgctgccacaataccTCGGCCCTTCTC AGTTCG | 24916 | CTACGACCca tacaccc | 25106 |
| 208 | caagacctcaatcctttgggtgtatgggtcgtagcgaactgagaagggcCGAGGTATTG TGGCAGCAA | 24917 | AGTTCCTAag accaaaa | 25107 |
| 209 | caagacctcaatcctttgggtgtatgggtcgtagcgaactgagaagggcCGAGGTATTG TGGCAGCAA | 24918 | AGTTCCTAag accaaaa | 25108 |
| 210 | tcactcaagcctgtggttttggtcttaggaactttgctgccacaataccTCGGCCCTTCTC AGTTCGC | 24919 | TACGACCCat acaccca | 25109 |
| 211 | caagacctcaatcctttgggtgtatgggtcgtagcgaactgagaagggcCGAGGTATTG TGGCAGCAA | 24920 | AGTTCCTAag accaaaa | 25110 |
| 214 | caagacctcaatcctttgggtgtatgggtcgtagcgaactgagaagggcCGAGGTATTG TGGCAGCAAA | 24921 | GTTCCTAAga ccaaaac | 25111 |
| 215 | tcactcaagcctgtggttttggtcttaggaactttgctgccacaataccTCGGCCCTTCTC AGTTCGCT | 24922 | ACGACCCAta cacccaa | 25112 |
| 217 | caagacctcaatcctttgggtgtatgggtcgtagcgaactgagaagggcCGAGGTATTG TGGCAGCAAA | 24923 | GTTCCTAAga ccaaaac | 25113 |
| 218 | caagacctcaatcctttgggtgtatgggtcgtagcgaactgagaagggcCGAGGTATTG TGGCAGCAAA | 24924 | GTTCCTAAga ccaaaac | 25114 |
| 221 | tcactcaagcctgtggttttggtcttaggaactttgctgccacaataccTCGGCCCTTCTC AGTTCGCTA | 24925 | CGACCCATac acccaaa | 25115 |
| 224 | caagacctcaatcctttgggtgtatgggtcgtagcgaactgagaagggcCGAGGTATTG TGGCAGCAAAG | 24926 | TTCCTAAGac caaaacc | 25116 |
| 228 | tcactcaagcctgtggttttggtcttaggaactttgctgccacaataccTCGGCCCTTCTC AGTTCGCTA | 24927 | CGACCCATac acccaaa | 25117 |
| 230 | caagacctcaatcctttgggtgtatgggtcgtagcgaactgagaagggcCGAGGTATTG TGGCAGCAAAG | 24928 | TTCCTAAGac caaaacc | 25118 |
| 231 | tcactcaagcctgtggttttggtcttaggaactttgctgccacaataccTCGGCCCTTCTC AGTTCGCTA | 24929 | CGACCCATac acccaaa | 25119 |
| 232 | tcactcaagcctgtggttttggtcttaggaactttgctgccacaataccTCGGCCCTTCTC AGTTCGCTA | 24930 | CGACCCATac acccaaa | 25120 |
| 238 | tcactcaagcctgtggttttggtcttaggaactttgctgccacaataccTCGGCCCTTCTC AGTTCGCTAC | 24931 | GACCCATAc acccaaag | 25121 |
| 239 | tcactcaagcctgtggttttggtcttaggaactttgctgccacaataccTCGGCCCTTCTC AGTTCGCTAC | 24932 | GACCCATAc acccaaag | 25122 |

TABLE 3A-continued

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 242 | tcactcaagcctgtggttttggtcttaggaactttgctgccacaataccTCGGCCCTTCTC AGTTCGCTAC | 24933 | GACCCATAc acccaaag | 25123 |
| 243 | tcactcaagcctgtggttttggtcttaggaactttgctgccacaataccTCGGCCCTTCTC AGTTCGCTAC | 24934 | GACCCATAc acccaaag | 25124 |
| 246 | caagacctcaatcctttgggtgtatgggtcgtagcgaactgagaagggcCGAGGTATTG TGGCAGCAAAGT | 24935 | TCCTAAGAcc aaaacca | 25125 |
| 247 | caagacctcaatcctttgggtgtatgggtcgtagcgaactgagaagggcCGAGGTATTG TGGCAGCAAAGT | 24936 | TCCTAAGAcc aaaacca | 25126 |
| 251 | tcactcaagcctgtggttttggtcttaggaactttgctgccacaataccTCGGCCCTTCTC AGTTCGCTACG | 24937 | ACCCATACac ccaaagg | 25127 |
| 252 | tcactcaagcctgtggttttggtcttaggaactttgctgccacaataccTCGGCCCTTCTC AGTTCGCTACG | 24938 | ACCCATACac ccaaagg | 25128 |
| 256 | tcactcaagcctgtggttttggtcttaggaactttgctgccacaataccTCGGCCCTTCTC AGTTCGCTACG | 24939 | ACCCATACac ccaaagg | 25129 |
| 257 | caagacctcaatcctttgggtgtatgggtcgtagcgaactgagaagggcCGAGGTATTG TGGCAGCAAAGTT | 24940 | CCTAAGACc aaaaccac | 25130 |
| 258 | caagacctcaatcctttgggtgtatgggtcgtagcgaactgagaagggcCGAGGTATTG TGGCAGCAAAGTT | 24941 | CCTAAGACc aaaaccac | 25131 |
| 264 | tcactcaagcctgtggttttggtcttaggaactttgctgccacaataccTCGGCCCTTCTC AGTTCGCTACGA | 24942 | CCCATACAcc caaagga | 25132 |
| 265 | tcactcaagcctgtggttttggtcttaggaactttgctgccacaataccTCGGCCCTTCTC AGTTCGCTACGA | 24943 | CCCATACAcc caaagga | 25133 |
| 266 | caagacctcaatcctttgggtgtatgggtcgtagcgaactgagaagggcCGAGGTATTG TGGCAGCAAAGTTC | 24944 | CTAAGACCa aaaccaca | 25134 |
| 268 | tcactcaagcctgtggttttggtcttaggaactttgctgccacaataccTCGGCCCTTCTC AGTTCGCTACGAC | 24945 | CCATACACcc aaaggat | 25135 |
| 269 | tcactcaagcctgtggttttggtcttaggaactttgctgccacaataccTCGGCCCTTCTC AGTTCGCTACGAC | 24946 | CCATACACcc aaaggat | 25136 |
| 270 | caagacctcaatcctttgggtgtatgggtcgtagcgaactgagaagggcCGAGGTATTG TGGCAGCAAAGTTCC | 24947 | TAAGACCAa aaccacag | 25137 |
| 271 | tcactcaagcctgtggttttggtcttaggaactttgctgccacaataccTCGGCCCTTCTC AGTTCGCTACGAC | 24948 | CCATACACcc aaaggat | 25138 |
| 272 | tcactcaagcctgtggttttggtcttaggaactttgctgccacaataccTCGGCCCTTCTC AGTTCGCTACGAC | 24949 | CCATACACcc aaaggat | 25139 |
| 274 | tcactcaagcctgtggttttggtcttaggaactttgctgccacaataccTCGGCCCTTCTC AGTTCGCTACGAC | 24950 | CCATACACcc aaaggat | 25140 |
| 275 | tcactcaagcctgtggttttggtcttaggaactttgctgccacaataccTCGGCCCTTCTC AGTTCGCTACGACC | 24951 | CATACACCca aaggatt | 25141 |
| 276 | tcactcaagcctgtggttttggtcttaggaactttgctgccacaataccTCGGCCCTTCTC AGTTCGCTACGACC | 24952 | CATACACCca aaggatt | 25142 |
| 280 | tcactcaagcctgtggttttggtcttaggaactttgctgccacaataccTCGGCCCTTCTC AGTTCGCTACGACC | 24953 | CATACACCca aaggatt | 25143 |

TABLE 3A-continued

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 281 | caagacctcaatcctttgggtgtatgggtcgtagcgaactgagaagggcCGAGGTATTG TGGCAGCAAAGTTCCT | 24954 | AAGACCAAa accacagg | 25144 |
| 286 | tcactcaagcctgtggttttggtcttaggaactttgctgccacaataccTCGGCCCTTCTC AGTTCGCTACGACCC | 24955 | ATACACCCaa aggattg | 25145 |
| 287 | tcactcaagcctgtggttttggtcttaggaactttgctgccacaataccTCGGCCCTTCTC AGTTCGCTACGACCC | 24956 | ATACACCCaa aggattg | 25146 |
| 288 | caagacctcaatcctttgggtgtatgggtcgtagcgaactgagaagggcCGAGGTATTG TGGCAGCAAAGTTCCTA | 24957 | AGACCAAAa ccacaggc | 25147 |
| 293 | caagacctcaatcctttgggtgtatgggtcgtagcgaactgagaagggcCGAGGTATTG TGGCAGCAAAGTTCCTAA | 24958 | GACCAAAAC cacaggct | 25148 |
| 297 | caagacctcaatcctttgggtgtatgggtcgtagcgaactgagaagggcCGAGGTATTG TGGCAGCAAAGTTCCTAA | 24959 | GACCAAAAc cacaggct | 25149 |
| 298 | tcactcaagcctgtggttttggtcttaggaactttgctgccacaataccTCGGCCCTTCTC AGTTCGCTACGACCCA | 24960 | TACACCCAaa ggattga | 25150 |
| 299 | caagacctcaatcctttgggtgtatgggtcgtagcgaactgagaagggcCGAGGTATTG TGGCAGCAAAGTTCCTAA | 24961 | GACCAAAAC cacaggct | 25151 |
| 300 | caagacctcaatcctttgggtgtatgggtcgtagcgaactgagaagggcCGAGGTATTG TGGCAGCAAAGTTCCTAA | 24962 | GACCAAAAC cacaggct | 25152 |
| 306 | caagacctcaatcctttgggtgtatgggtcgtagcgaactgagaagggcCGAGGTATTG TGGCAGCAAAGTTCCTAAG | 24963 | ACCAAAACc acaggctt | 25153 |
| 307 | caagacctcaatcctttgggtgtatgggtcgtagcgaactgagaagggcCGAGGTATTG TGGCAGCAAAGTTCCTAAG | 24964 | ACCAAAACc acaggctt | 25154 |
| 310 | caagacctcaatcctttgggtgtatgggtcgtagcgaactgagaagggcCGAGGTATTG TGGCAGCAAAGTTCCTAAG | 24965 | ACCAAAACc acaggctt | 25155 |
| 311 | caagacctcaatcctttgggtgtatgggtcgtagcgaactgagaagggcCGAGGTATTG TGGCAGCAAAGTTCCTAAG | 24966 | ACCAAAACc acaggctt | 25156 |
| 314 | caagacctcaatcctttgggtgtatgggtcgtagcgaactgagaagggcCGAGGTATTG TGGCAGCAAAGTTCCTAAG | 24967 | ACCAAAACc acaggctt | 25157 |
| 315 | tcactcaagcctgtggttttggtcttaggaactttgctgccacaataccTCGGCCCTTCTC AGTTCGCTACGACCCAT | 24968 | ACACCCAAa ggattgag | 25158 |
| 318 | caagacctcaatcctttgggtgtatgggtcgtagcgaactgagaagggcCGAGGTATTG TGGCAGCAAAGTTCCTAAG | 24969 | ACCAAAACc acaggctt | 25159 |
| 322 | tcactcaagcctgtggttttggtcttaggaactttgctgccacaataccTCGGCCCTTCTC AGTTCGCTACGACCCAT | 24970 | ACACCCAAa ggattgag | 25160 |
| 328 | caagacctcaatcctttgggtgtatgggtcgtagcgaactgagaagggcCGAGGTATTG TGGCAGCAAAGTTCCTAAGA | 24971 | CCAAAACCa caggcttg | 25161 |
| 329 | caagacctcaatcctttgggtgtatgggtcgtagcgaactgagaagggcCGAGGTATTG TGGCAGCAAAGTTCCTAAGA | 24972 | CCAAAACCa caggcttg | 25162 |
| 330 | caagacctcaatcctttgggtgtatgggtcgtagcgaactgagaagggcCGAGGTATTG TGGCAGCAAAGTTCCTAAGA | 24973 | CCAAAACCa caggcttg | 25163 |
| 331 | caagacctcaatcctttgggtgtatgggtcgtagcgaactgagaagggcCGAGGTATTG TGGCAGCAAAGTTCCTAAGA | 24974 | CCAAAACCa caggcttg | 25164 |

TABLE 3A-continued

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 334 | tcactcaagcctgtggttttggtcttaggaactttgctgccacaataccTCGGCCCTTCTCAGTTCGCTACGACCCATA | 24975 | CACCCAAAggattgagg | 25165 |
| 335 | tcactcaagcctgtggttttggtcttaggaactttgctgccacaataccTCGGCCCTTCTCAGTTCGCTACGACCCATA | 24976 | CACCCAAAggattgagg | 25166 |
| 338 | tcactcaagcctgtggttttggtcttaggaactttgctgccacaataccTCGGCCCTTCTCAGTTCGCTACGACCCATA | 24977 | CACCCAAAggattgagg | 25167 |
| 341 | caagacctcaatcctttgggtgtatgggtcgtagcgaactgagaagggcCGAGGTATTGTGGCAGCAAAGTTCCTAAGA | 24978 | CCAAAACCacaggcttg | 25168 |
| 342 | caagacctcaatcctttgggtgtatgggtcgtagcgaactgagaagggcCGAGGTATTGTGGCAGCAAAGTTCCTAAGA | 24979 | CCAAAACCacaggcttg | 25169 |
| 343 | tcactcaagcctgtggttttggtcttaggaactttgctgccacaataccTCGGCCCTTCTCAGTTCGCTACGACCCATA | 24980 | CACCCAAAggattgagg | 25170 |
| 346 | tcactcaagcctgtggttttggtcttaggaactttgctgccacaataccTCGGCCCTTCTCAGTTCGCTACGACCCATA | 24981 | CACCCAAAggattgagg | 25171 |
| 347 | tcactcaagcctgtggttttggtcttaggaactttgctgccacaataccTCGGCCCTTCTCAGTTCGCTACGACCCATA | 24982 | CACCCAAAggattgagg | 25172 |
| 351 | caagacctcaatcctttgggtgtatgggtcgtagcgaactgagaagggcCGAGGTATTGTGGCAGCAAAGTTCCTAAGAC | 24983 | CAAAACCAcaggcttga | 25173 |
| 352 | tcactcaagcctgtggttttggtcttaggaactttgctgccacaataccTCGGCCCTTCTCAGTTCGCTACGACCCATAC | 24984 | ACCCAAAGgattgaggt | 25174 |
| 353 | tcactcaagcctgtggttttggtcttaggaactttgctgccacaataccTCGGCCCTTCTCAGTTCGCTACGACCCATAC | 24985 | ACCCAAAGgattgaggt | 25175 |
| 354 | caagacctcaatcctttgggtgtatgggtcgtagcgaactgagaagggcCGAGGTATTGTGGCAGCAAAGTTCCTAAGAC | 24986 | CAAAACCAcaggcttga | 25176 |
| 357 | tcactcaagcctgtggttttggtcttaggaactttgctgccacaataccTCGGCCCTTCTCAGTTCGCTACGACCCATAC | 24987 | ACCCAAAGgattgaggt | 25177 |
| 358 | tcactcaagcctgtggttttggtcttaggaactttgctgccacaataccTCGGCCCTTCTCAGTTCGCTACGACCCATAC | 24988 | ACCCAAAGgattgaggt | 25178 |
| 361 | tcactcaagcctgtggttttggtcttaggaactttgctgccacaataccTCGGCCCTTCTCAGTTCGCTACGACCCATAC | 24989 | ACCCAAAGgattgaggt | 25179 |
| 362 | tcactcaagcctgtggttttggtcttaggaactttgctgccacaataccTCGGCCCTTCTCAGTTCGCTACGACCCATAC | 24990 | ACCCAAAGgattgaggt | 25180 |
| 365 | caagacctcaatcctttgggtgtatgggtcgtagcgaactgagaagggcCGAGGTATTGTGGCAGCAAAGTTCCTAAGAC | 24991 | CAAAACCAcaggcttga | 25181 |
| 366 | caagacctcaatcctttgggtgtatgggtcgtagcgaactgagaagggcCGAGGTATTGTGGCAGCAAAGTTCCTAAGAC | 24992 | CAAAACCAcaggcttga | 25182 |
| 369 | tcactcaagcctgtggttttggtcttaggaactttgctgccacaataccTCGGCCCTTCTCAGTTCGCTACGACCCATACA | 24993 | CCCAAAGGattgaggtc | 25183 |
| 370 | tcactcaagcctgtggttttggtcttaggaactttgctgccacaataccTCGGCCCTTCTCAGTTCGCTACGACCCATACA | 24994 | CCCAAAGGattgaggtc | 25184 |
| 371 | tcactcaagcctgtggttttggtcttaggaactttgctgccacaataccTCGGCCCTTCTCAGTTCGCTACGACCCATACA | 24995 | CCCAAAGGattgaggtc | 25185 |

TABLE 3A-continued

Exmplary RT sequence (heterologous object sequence) and PBS sequence pairs
Table 3A provides exemplified PBS sequences and heterologous object sequences (reverse transcription template regions) of a template RNA for correcting the pathogenic R408W mutation in PAH. The gRNA spacers from Table 1A were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1A, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 372 | tcactcaagcctgtggttttggtcttaggaactttgctgccacaataccTCGGCCCTTCTCAGTTCGCTACGACCCATACA | 24996 | CCCAAAGGattgaggtc | 25186 |
| 375 | caagacctcaatcctttgggtgtatgggtcgtagcgaactgagaagggcCGAGGTATTGTGGCAGCAAAGTTCCTAAGACC | 24997 | AAAACCACaggcttgag | 25187 |
| 376 | tcactcaagcctgtggttttggtcttaggaactttgctgccacaataccTCGGCCCTTCTCAGTTCGCTACGACCCATACA | 24998 | CCCAAAGGattgaggtc | 25188 |
| 377 | tcactcaagcctgtggttttggtcttaggaactttgctgccacaataccTCGGCCCTTCTCAGTTCGCTACGACCCATACA | 24999 | CCCAAAGGattgaggtc | 25189 |
| 380 | tcactcaagcctgtggttttggtcttaggaactttgctgccacaataccTCGGCCCTTCTCAGTTCGCTACGACCCATACA | 25000 | CCCAAAGGattgaggtc | 25190 |
| 381 | tcactcaagcctgtggttttggtcttaggaactttgctgccacaataccTCGGCCCTTCTCAGTTCGCTACGACCCATACA | 25001 | CCCAAAGGattgaggtc | 25191 |
| 382 | caagacctcaatcctttgggtgtatgggtcgtagcgaactgagaagggcCGAGGTATTGTGGCAGCAAAGTTCCTAAGACC | 25002 | AAAACCACaggcttgag | 25192 |

TABLE 3B

Exemplary RT sequence (heterologous object sequence) and PBS sequence pairs
Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 1 | tatacatgggcttggatccatgtctgatgtactgtgtgcagtggaagacTC | 25193 | GGAAGGCCaggccaccc | 25370 |
| 2 | tatacatgggcttggatccatgtctgatgtactgtgtgcagtggaagacTC | 25194 | GGAAGGCCaggccaccc | 25371 |
| 3 | tatacatgggcttggatccatgtctgatgtactgtgtgcagtggaagacTC | 25195 | GGAAGGCCaggccaccc | 25372 |
| 4 | tgtggctggcctgctttcctctcgggatttcttgggtggcctggccttcCGA | 25196 | GTCTTCCActgcacaca | 25373 |
| 5 | tgtggctggcctgctttcctctcgggatttcttgggtggcctggccttcCGA | 25197 | GTCTTCCActgcacaca | 25374 |

TABLE 3B-continued

Exemplary RT sequence (heterologous object sequence) and PBS sequence pairs Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 8 | tgtggctggcctgctttcctctcgggatttcttgggtggcctggccttcCGA | 25198 | GTCTTCCActg cacaca | 25375 |
| 10 | tatacatgggcttggatccatgtctgatgtactgtgtgcagtggaagacTCG | 25199 | GAAGGCCAg gccaccca | 25376 |
| 13 | tgtggctggcctgctttcctctcgggatttcttgggtggcctggccttcCGAG | 25200 | TCTTCCACtgc acacag | 25377 |
| 14 | tatacatgggcttggatccatgtctgatgtactgtgtgcagtggaagacTCGG | 25201 | AAGGCCAGg ccacccaa | 25378 |
| 17 | tgtggctggcctgctttcctctcgggatttcttgggtggcctggccttcCGAG | 25202 | TCTTCCACtgc acacag | 25379 |
| 21 | tatacatgggcttggatccatgtctgatgtactgtgtgcagtggaagacTCGG | 25203 | AAGGCCAGg ccacccaa | 25380 |
| 23 | tgtggctggcctgctttcctctcgggatttcttgggtggcctggccttcCGAG | 25204 | TCTTCCACtgc acacag | 25381 |
| 29 | tgtggctggcctgctttcctctcgggatttcttgggtggcctggccttcCGAGT | 25205 | CTTCCACTgc acacagt | 25382 |
| 30 | tgtggctggcctgctttcctctcgggatttcttgggtggcctggccttcCGAGT | 25206 | CTTCCACTgc acacagt | 25383 |
| 33 | tatacatgggcttggatccatgtctgatgtactgtgtgcagtggaagacTCGGA | 25207 | AGGCCAGGc cacccaag | 25384 |
| 34 | tatacatgggcttggatccatgtctgatgtactgtgtgcagtggaagacTCGGA | 25208 | AGGCCAGGc cacccaag | 25385 |
| 37 | tgtggctggcctgctttcctctcgggatttcttgggtggcctggccttcCGAGT | 25209 | CTTCCACTgc acacagt | 25386 |
| 38 | tgtggctggcctgctttcctctcgggatttcttgggtggcctggccttcCGAGT | 25210 | CTTCCACTgc acacagt | 25387 |
| 41 | tgtggctggcctgctttcctctcgggatttcttgggtggcctggccttcCGAGT | 25211 | CTTCCACTgc acacagt | 25388 |
| 42 | tgtggctggcctgctttcctctcgggatttcttgggtggcctggccttcCGAGT | 25212 | CTTCCACTgc acacagt | 25389 |
| 45 | tatacatgggcttggatccatgtctgatgtactgtgtgcagtggaagacTCGGA | 25213 | AGGCCAGGc cacccaag | 25390 |
| 51 | tgtggctggcctgctttcctctcgggatttcttgggtggcctggccttcCGAGTC | 25214 | TTCCACTGca cacagta | 25391 |
| 52 | tgtggctggcctgctttcctctcgggatttcttgggtggcctggccttcCGAGTC | 25215 | TTCCACTGca cacagta | 25392 |
| 53 | tgtggctggcctgctttcctctcgggatttcttgggtggcctggccttcCGAGTC | 25216 | TTCCACTGca cacagta | 25393 |
| 54 | tgtggctggcctgctttcctctcgggatttcttgggtggcctggccttcCGAGTC | 25217 | TTCCACTGca cacagta | 25394 |

TABLE 3B-continued

Exemplary RT sequence (heterologous object sequence) and PBS sequence pairs Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 55 | tatacatgggcttggatccatgtctgatgtactgtgtgcagtggaagacTCGGAA | 25218 | GGCCAGGCca cccaaga | 25395 |
| 60 | tgtggctggcctgctttcctctcgggatttcttgggtggcctggccttcCGAGTC | 25219 | TTCCACTGca cacagta | 25396 |
| 61 | tgtggctggcctgctttcctctcgggatttcttgggtggcctggccttcCGAGTC | 25220 | TTCCACTGca cacagta | 25397 |
| 62 | tatacatgggcttggatccatgtctgatgtactgtgtgcagtggaagacTCGGAA | 25221 | GGCCAGGCca cccaaga | 25398 |
| 65 | tatacatgggcttggatccatgtctgatgtactgtgtgcagtggaagacTCGGAAG | 25222 | GCCAGGCCac ccaagaa | 25399 |
| 66 | tgtggctggcctgctttcctctcgggatttcttgggtggcctggccttcCGAGTCT | 25223 | TCCACTGCac acagtac | 25400 |
| 67 | tatacatgggcttggatccatgtctgatgtactgtgtgcagtggaagacTCGGAAG | 25224 | GCCAGGCCac ccaagaa | 25401 |
| 70 | tgtggctggcctgctttcctctcgggatttcttgggtggcctggccttcCGAGTCT | 25225 | TCCACTGCac acagtac | 25402 |
| 71 | tatacatgggcttggatccatgtctgatgtactgtgtgcagtggaagacTCGGAAG | 25226 | GCCAGGCCac ccaagaa | 25403 |
| 73 | tatacatgggcttggatccatgtctgatgtactgtgtgcagtggaagacTCGGAAGG | 25227 | CCAGGCCAcc caagaaa | 25404 |
| 74 | tgtggctggcctgctttcctctcgggatttcttgggtggcctggccttcCGAGTCTT | 25228 | CCACTGCAca cagtaca | 25405 |
| 75 | tatacatgggcttggatccatgtctgatgtactgtgtgcagtggaagacTCGGAAGG | 25229 | CCAGGCCAcc caagaaa | 25406 |
| 78 | tgtggctggcctgctttcctctcgggatttcttgggtggcctggccttcCGAGTCTTC | 25230 | CACTGCACac agtacat | 25407 |
| 79 | tatacatgggcttggatccatgtctgatgtactgtgtgcagtggaagacTCGGAAGGC | 25231 | CAGGCCACcc aagaaat | 25408 |
| 81 | tgtggctggcctgctttcctctcgggatttcttgggtggcctggccttcCGAGTCTTCC | 25232 | ACTGCACAca gtacatc | 25409 |
| 85 | tgtggctggcctgctttcctctcgggatttcttgggtggcctggccttcCGAGTCTTCC | 25233 | ACTGCACAca gtacatc | 25410 |
| 86 | tatacatgggcttggatccatgtctgatgtactgtgtgcagtggaagacTCGGAAGGCC | 25234 | AGGCCACCca agaaatc | 25411 |
| 87 | tatacatgggcttggatccatgtctgatgtactgtgtgcagtggaagacTCGGAAGGCC | 25235 | AGGCCACCca agaaatc | 25412 |
| 88 | tatacatgggcttggatccatgtctgatgtactgtgtgcagtggaagacTCGGAAGGCC | 25236 | AGGCCACCca agaaatc | 25413 |
| 91 | tatacatgggcttggatccatgtctgatgtactgtgtgcagtggaagacTCGGAAGGCC A | 25237 | GGCCACCCaa gaaatcc | 25414 |

TABLE 3B-continued

Exemplary RT sequence (heterologous object sequence) and PBS sequence pairs Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 94 | tgtggctggcctgctttcctctcgggatttcttgggtggcctggccttcCGAGTCTTCCA | 25238 | CTGCACACag tacatca | 25415 |
| 95 | tgtggctggcctgctttcctctcgggatttcttgggtggcctggccttcCGAGTCTTCCA | 25239 | CTGCACACag tacatca | 25416 |
| 96 | tatacatgggcttggatccatgtctgatgtactgtgtgcagtggaagacTCGGAAGGCC A | 25240 | GGCCACCCaa gaaatcc | 25417 |
| 97 | tgtggctggcctgctttcctctcgggatttcttgggtggcctggccttcCGAGTCTTCCA | 25241 | CTGCACACag tacatca | 25418 |
| 98 | tatacatgggcttggatccatgtctgatgtactgtgtgcagtggaagacTCGGAAGGCC A | 25242 | GGCCACCCaa gaaatcc | 25419 |
| 99 | tatacatgggcttggatccatgtctgatgtactgtgtgcagtggaagacTCGGAAGGCC A | 25243 | GGCCACCCaa gaaatcc | 25420 |
| 100 | tgtggctggcctgctttcctctcgggatttcttgggtggcctggccttcCGAGTCTTCCA | 25244 | CTGCACACag tacatca | 25421 |
| 101 | tatacatgggcttggatccatgtctgatgtactgtgtgcagtggaagacTCGGAAGGCC A | 25245 | GGCCACCCaa gaaatcc | 25422 |
| 106 | tgtggctggcctgctttcctctcgggatttcttgggtggcctggccttcCGAGTCTTCCA C | 25246 | TGCACACAgt acatcag | 25423 |
| 107 | tgtggctggcctgctttcctctcgggatttcttgggtggcctggccttcCGAGTCTTCCA C | 25247 | TGCACACAgt acatcag | 25424 |
| 110 | tgtggctggcctgctttcctctcgggatttcttgggtggcctggccttcCGAGTCTTCCA C | 25248 | TGCACACAgt acatcag | 25425 |
| 112 | tatacatgggcttggatccatgtctgatgtactgtgtgcagtggaagacTCGGAAGGCC AG | 25249 | GCCACCCAag aaatccc | 25426 |
| 115 | tgtggctggcctgctttcctctcgggatttcttgggtggcctggccttcCGAGTCTTCCA CT | 25250 | GCACACAGta catcaga | 25427 |
| 116 | tgtggctggcctgctttcctctcgggatttcttgggtggcctggccttcCGAGTCTTCCA CT | 25251 | GCACACAGta catcaga | 25428 |
| 119 | tatacatgggcttggatccatgtctgatgtactgtgtgcagtggaagacTCGGAAGGCC AGG | 25252 | CCACCCAAga aatcccg | 25429 |
| 123 | tgtggctggcctgctttcctctcgggatttcttgggtggcctggccttcCGAGTCTTCCA CT | 25253 | GCACACAGta catcaga | 25430 |
| 125 | tatacatgggcttggatccatgtctgatgtactgtgtgcagtggaagacTCGGAAGGCC AGG | 25254 | CCACCCAAga aatcccg | 25431 |
| 132 | tgtggctggcctgctttcctctcgggatttcttgggtggcctggccttcCGAGTCTTCCA CTG | 25255 | CACACAGTac atcagac | 25432 |
| 133 | tgtggctggcctgctttcctctcgggatttcttgggtggcctggccttcCGAGTCTTCCA CTG | 25256 | CACACAGTac atcagac | 25433 |
| 136 | tgtggctggcctgctttcctctcgggatttcttgggtggcctggccttcCGAGTCTTCCA CTG | 25257 | CACACAGTac atcagac | 25434 |

TABLE 3B-continued

Exemplary RT sequence (heterologous object sequence) and PBS sequence pairs Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 137 | tgtggctggcctgctttcctctcgggatttcttgggtggcctggccttcCGAGTCTTCCACTG | 25258 | CACACAGTacatcagac | 25435 |
| 140 | tgtggctggcctgctttcctctcgggatttcttgggtggcctggccttcCGAGTCTTCCACTG | 25259 | CACACAGTacatcagac | 25436 |
| 143 | tatacatgggcttggatccatgtctgatgtactgtgtgcagtggaagacTCGGAAGGCCAGGC | 25260 | CACCCAAGaaatcccga | 25437 |
| 144 | tatacatgggcttggatccatgtctgatgtactgtgtgcagtggaagacTCGGAAGGCCAGGC | 25261 | CACCCAAGaaatcccga | 25438 |
| 147 | tatacatgggcttggatccatgtctgatgtactgtgtgcagtggaagacTCGGAAGGCCAGGC | 25262 | CACCCAAGaaatcccga | 25439 |
| 148 | tgtggctggcctgctttcctctcgggatttcttgggtggcctggccttcCGAGTCTTCCACTG | 25263 | CACACAGTacatcagac | 25440 |
| 151 | tatacatgggcttggatccatgtctgatgtactgtgtgcagtggaagacTCGGAAGGCCAGGC | 25264 | CACCCAAGaaatcccga | 25441 |
| 154 | tatacatgggcttggatccatgtctgatgtactgtgtgcagtggaagacTCGGAAGGCCAGGC | 25265 | CACCCAAGaaatcccga | 25442 |
| 160 | tatacatgggcttggatccatgtctgatgtactgtgtgcagtggaagacTCGGAAGGCCAGGCC | 25266 | ACCCAAGAaatcccgag | 25443 |
| 161 | tgtggctggcctgctttcctctcgggatttcttgggtggcctggccttcCGAGTCTTCCACTGC | 25267 | ACACAGTAcatcagaca | 25444 |
| 162 | tgtggctggcctgctttcctctcgggatttcttgggtggcctggccttcCGAGTCTTCCACTGC | 25268 | ACACAGTAcatcagaca | 25445 |
| 163 | tgtggctggcctgctttcctctcgggatttcttgggtggcctggccttcCGAGTCTTCCACTGC | 25269 | ACACAGTAcatcagaca | 25446 |
| 164 | tgtggctggcctgctttcctctcgggatttcttgggtggcctggccttcCGAGTCTTCCACTGC | 25270 | ACACAGTAcatcagaca | 25447 |
| 165 | tatacatgggcttggatccatgtctgatgtactgtgtgcagtggaagacTCGGAAGGCCAGGCC | 25271 | ACCCAAGAaatcccgag | 25448 |
| 166 | tatacatgggcttggatccatgtctgatgtactgtgtgcagtggaagacTCGGAAGGCCAGGCC | 25272 | ACCCAAGAaatcccgag | 25449 |
| 169 | tgtggctggcctgctttcctctcgggatttcttgggtggcctggccttcCGAGTCTTCCACTGC | 25273 | ACACAGTAcatcagaca | 25450 |
| 170 | tgtggctggcctgctttcctctcgggatttcttgggtggcctggccttcCGAGTCTTCCACTGC | 25274 | ACACAGTAcatcagaca | 25451 |
| 173 | tatacatgggcttggatccatgtctgatgtactgtgtgcagtggaagacTCGGAAGGCCAGGCC | 25275 | ACCCAAGAaatcccgag | 25452 |
| 174 | tatacatgggcttggatccatgtctgatgtactgtgtgcagtggaagacTCGGAAGGCCAGGCC | 25276 | ACCCAAGAaatcccgag | 25453 |
| 175 | tatacatgggcttggatccatgtctgatgtactgtgtgcagtggaagacTCGGAAGGCCAGGCC | 25277 | ACCCAAGAaatcccgag | 25454 |

TABLE 3B-continued

Exemplary RT sequence (heterologous object sequence) and PBS sequence pairs Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 176 | tatacatgggcttggatccatgtctgatgtactgtgtgcagtggaagacTCGGAAGGCC AGGCC | 25278 | ACCCAAGAaa tcccgag | 25455 |
| 179 | tgtggctggcctgctttcctctcgggatttcttgggtggcctggccttcCGAGTCTTCCA CTGCA | 25279 | CACAGTACat cagacat | 25456 |
| 180 | tatacatgggcttggatccatgtctgatgtactgtgtgcagtggaagacTCGGAAGGCC AGGCCA | 25280 | CCCAAGAAat cccgaga | 25457 |
| 181 | tgtggctggcctgctttcctctcgggatttcttgggtggcctggccttcCGAGTCTTCCA CTGCA | 25281 | CACAGTACat cagacat | 25458 |
| 185 | tgtggctggcctgctttcctctcgggatttcttgggtggcctggccttcCGAGTCTTCCA CTGCA | 25282 | CACAGTACat cagacat | 25459 |
| 186 | tatacatgggcttggatccatgtctgatgtactgtgtgcagtggaagacTCGGAAGGCC AGGCCA | 25283 | CCCAAGAAat cccgaga | 25460 |
| 189 | tgtggctggcctgctttcctctcgggatttcttgggtggcctggccttcCGAGTCTTCCA CTGCAC | 25284 | ACAGTACAtc agacatg | 25461 |
| 190 | tgtggctggcctgctttcctctcgggatttcttgggtggcctggccttcCGAGTCTTCCA CTGCAC | 25285 | ACAGTACAtc agacatg | 25462 |
| 191 | tatacatgggcttggatccatgtctgatgtactgtgtgcagtggaagacTCGGAAGGCC AGGCCAC | 25286 | CCAAGAAAtc ccgagag | 25463 |
| 193 | tgtggctggcctgctttcctctcgggatttcttgggtggcctggccttcCGAGTCTTCCA CTGCACA | 25287 | CAGTACATca gacatgg | 25464 |
| 194 | tatacatgggcttggatccatgtctgatgtactgtgtgcagtggaagacTCGGAAGGCC AGGCCACC | 25288 | CAAGAAATcc cgagagg | 25465 |
| 198 | tatacatgggcttggatccatgtctgatgtactgtgtgcagtggaagacTCGGAAGGCC AGGCCACC | 25289 | CAAGAAATcc cgagagg | 25466 |
| 199 | tgtggctggcctgctttcctctcgggatttcttgggtggcctggccttcCGAGTCTTCCA CTGCACA | 25290 | CAGTACATca gacatgg | 25467 |
| 203 | tgtggctggcctgctttcctctcgggatttcttgggtggcctggccttcCGAGTCTTCCA CTGCACAC | 25291 | AGTACATCag acatgga | 25468 |
| 204 | tgtggctggcctgctttcctctcgggatttcttgggtggcctggccttcCGAGTCTTCCA CTGCACAC | 25292 | AGTACATCag acatgga | 25469 |
| 209 | tatacatgggcttggatccatgtctgatgtactgtgtgcagtggaagacTCGGAAGGCC AGGCCACCC | 25293 | AAGAAATCcc gagagga | 25470 |
| 210 | tatacatgggcttggatccatgtctgatgtactgtgtgcagtggaagacTCGGAAGGCC AGGCCACCC | 25294 | AAGAAATCcc gagagga | 25471 |
| 213 | tatacatgggcttggatccatgtctgatgtactgtgtgcagtggaagacTCGGAAGGCC AGGCCACCC | 25295 | AAGAAATCcc gagagga | 25472 |
| 214 | tgtggctggcctgctttcctctcgggatttcttgggtggcctggccttcCGAGTCTTCCA CTGCACAC | 25296 | AGTACATCag acatgga | 25473 |
| 217 | tatacatgggcttggatccatgtctgatgtactgtgtgcagtggaagacTCGGAAGGCC AGGCCACCC | 25297 | AAGAAATCcc gagagga | 25474 |

TABLE 3B-continued

Exemplary RT sequence (heterologous object sequence) and PBS sequence pairs Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 221 | tgtggctggcctgctttcctctcgggatttcttgggtggcctggccttcCGAGTCTTCCA CTGCACAC | 25298 | AGTACATCag acatgga | 25475 |
| 222 | tatacatgggcttggatccatgtctgatgtactgtgtgcagtggaagacTCGGAAGGCC AGGCCACCC | 25299 | AAGAAATCcc gagagga | 25476 |
| 223 | tatacatgggcttggatccatgtctgatgtactgtgtgcagtggaagacTCGGAAGGCC AGGCCACCC | 25300 | AAGAAATCcc gagagga | 25477 |
| 226 | tatacatgggcttggatccatgtctgatgtactgtgtgcagtggaagacTCGGAAGGCC AGGCCACCCA | 25301 | AGAAATCCcg agaggaa | 25478 |
| 227 | tatacatgggcttggatccatgtctgatgtactgtgtgcagtggaagacTCGGAAGGCC AGGCCACCCA | 25302 | AGAAATCCcg agaggaa | 25479 |
| 228 | tatacatgggcttggatccatgtctgatgtactgtgtgcagtggaagacTCGGAAGGCC AGGCCACCCA | 25303 | AGAAATCCcg agaggaa | 25480 |
| 231 | tgtggctggcctgctttcctctcgggatttcttgggtggcctggccttcCGAGTCTTCCA CTGCACACA | 25304 | GTACATCAga catggat | 25481 |
| 232 | tgtggctggcctgctttcctctcgggatttcttgggtggcctggccttcCGAGTCTTCCA CTGCACACA | 25305 | GTACATCAga catggat | 25482 |
| 235 | tatacatgggcttggatccatgtctgatgtactgtgtgcagtggaagacTCGGAAGGCC AGGCCACCCA | 25306 | AGAAATCCcg agaggaa | 25483 |
| 236 | tatacatgggcttggatccatgtctgatgtactgtgtgcagtggaagacTCGGAAGGCC AGGCCACCCA | 25307 | AGAAATCCcg agaggaa | 25484 |
| 237 | tatacatgggcttggatccatgtctgatgtactgtgtgcagtggaagacTCGGAAGGCC AGGCCACCCA | 25308 | AGAAATCCcg agaggaa | 25485 |
| 238 | tatacatgggcttggatccatgtctgatgtactgtgtgcagtggaagacTCGGAAGGCC AGGCCACCCA | 25309 | AGAAATCCcg agaggaa | 25486 |
| 239 | tatacatgggcttggatccatgtctgatgtactgtgtgcagtggaagacTCGGAAGGCC AGGCCACCCAA | 25310 | GAAATCCCga gaggaaa | 25487 |
| 240 | tgtggctggcctgctttcctctcgggatttcttgggtggcctggccttcCGAGTCTTCCA CTGCACACAG | 25311 | TACATCAGac atggatc | 25488 |
| 243 | tatacatgggcttggatccatgtctgatgtactgtgtgcagtggaagacTCGGAAGGCC AGGCCACCCAA | 25312 | GAAATCCCga gaggaaa | 25489 |
| 247 | tgtggctggcctgctttcctctcgggatttcttgggtggcctggccttcCGAGTCTTCCA CTGCACACAG | 25313 | TACATCAGac atggatc | 25490 |
| 249 | tatacatgggcttggatccatgtctgatgtactgtgtgcagtggaagacTCGGAAGGCC AGGCCACCCAA | 25314 | GAAATCCCga gaggaaa | 25491 |
| 250 | tgtggctggcctgctttcctctcgggatttcttgggtggcctggccttcCGAGTCTTCCA CTGCACACAG | 25315 | TACATCAGac atggatc | 25492 |
| 251 | tgtggctggcctgctttcctctcgggatttcttgggtggcctggccttcCGAGTCTTCCA CTGCACACAG | 25316 | TACATCAGac atggatc | 25493 |
| 254 | tgtggctggcctgctttcctctcgggatttcttgggtggcctggccttcCGAGTCTTCCA CTGCACACAGT | 25317 | ACATCAGAca tggatcc | 25494 |

TABLE 3B-continued

Exemplary RT sequence (heterologous object sequence) and PBS sequence pairs Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 255 | tgtggctggcctgctttcctctcgggatttcttgggtggcctggccttcCGAGTCTTCCA CTGCACACAGT | 25318 | ACATCAGAca tggatcc | 25495 |
| 258 | tatacatgggcttggatccatgtctgatgtactgtgtgcagtggaagacTCGGAAGGCC AGGCCACCCAAG | 25319 | AAATCCCGag aggaaag | 25496 |
| 259 | tatacatgggcttggatccatgtctgatgtactgtgtgcagtggaagacTCGGAAGGCC AGGCCACCCAAG | 25320 | AAATCCCGag aggaaag | 25497 |
| 262 | tatacatgggcttggatccatgtctgatgtactgtgtgcagtggaagacTCGGAAGGCC AGGCCACCCAAG | 25321 | AAATCCCGag aggaaag | 25498 |
| 263 | tatacatgggcttggatccatgtctgatgtactgtgtgcagtggaagacTCGGAAGGCC AGGCCACCCAAG | 25322 | AAATCCCGag aggaaag | 25499 |
| 267 | tatacatgggcttggatccatgtctgatgtactgtgtgcagtggaagacTCGGAAGGCC AGGCCACCCAAGA | 25323 | AATCCCGAga ggaaagc | 25500 |
| 268 | tatacatgggcttggatccatgtctgatgtactgtgtgcagtggaagacTCGGAAGGCC AGGCCACCCAAGA | 25324 | AATCCCGAga ggaaagc | 25501 |
| 271 | tatacatgggcttggatccatgtctgatgtactgtgtgcagtggaagacTCGGAAGGCC AGGCCACCCAAGA | 25325 | AATCCCGAga ggaaagc | 25502 |
| 272 | tatacatgggcttggatccatgtctgatgtactgtgtgcagtggaagacTCGGAAGGCC AGGCCACCCAAGA | 25326 | AATCCCGAga ggaaagc | 25503 |
| 275 | tatacatgggcttggatccatgtctgatgtactgtgtgcagtggaagacTCGGAAGGCC AGGCCACCCAAGA | 25327 | AATCCCGAga ggaaagc | 25504 |
| 276 | tgtggctggcctgctttcctctcgggatttcttgggtggcctggccttcCGAGTCTTCCA CTGCACACAGTA | 25328 | CATCAGACat ggatcca | 25505 |
| 279 | tatacatgggcttggatccatgtctgatgtactgtgtgcagtggaagacTCGGAAGGCC AGGCCACCCAAGA | 25329 | AATCCCGAga ggaaagc | 25506 |
| 283 | tgtggctggcctgctttcctctcgggatttcttgggtggcctggccttcCGAGTCTTCCA CTGCACACAGTA | 25330 | CATCAGACat ggatcca | 25507 |
| 286 | tatacatgggcttggatccatgtctgatgtactgtgtgcagtggaagacTCGGAAGGCC AGGCCACCCAAGAA | 25331 | ATCCCGAGag gaaagca | 25508 |
| 287 | tatacatgggcttggatccatgtctgatgtactgtgtgcagtggaagacTCGGAAGGCC AGGCCACCCAAGAA | 25332 | ATCCCGAGag gaaagca | 25509 |
| 288 | tatacatgggcttggatccatgtctgatgtactgtgtgcagtggaagacTCGGAAGGCC AGGCCACCCAAGAA | 25333 | ATCCCGAGag gaaagca | 25510 |
| 289 | tatacatgggcttggatccatgtctgatgtactgtgtgcagtggaagacTCGGAAGGCC AGGCCACCCAAGAA | 25334 | ATCCCGAGag gaaagca | 25511 |
| 292 | tatacatgggcttggatccatgtctgatgtactgtgtgcagtggaagacTCGGAAGGCC AGGCCACCCAAGAA | 25335 | ATCCCGAGag gaaagca | 25512 |
| 293 | tatacatgggcttggatccatgtctgatgtactgtgtgcagtggaagacTCGGAAGGCC AGGCCACCCAAGAA | 25336 | ATCCCGAGag gaaagca | 25513 |
| 296 | tgtggctggcctgctttcctctcgggatttcttgggtggcctggccttcCGAGTCTTCCA CTGCACACAGTAC | 25337 | ATCAGACAtg gatccaa | 25514 |

TABLE 3B-continued

Exemplary RT sequence (heterologous object sequence) and PBS sequence pairs Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 297 | tgtggctggcctgctttcctctcgggatttcttgggtggcctggccttcCGAGTCTTCCACTGCACACAGTAC | 25338 | ATCAGACAtggatccaa | 25515 |
| 300 | tatacatgggcttggatccatgtctgatgtactgtgtgcagtggaagacTCGGAAGGCCAGGCCACCCAAGAA | 25339 | ATCCCGAGaggaaagca | 25516 |
| 301 | tatacatgggcttggatccatgtctgatgtactgtgtgcagtggaagacTCGGAAGGCCAGGCCACCCAAGAA | 25340 | ATCCCGAGaggaaagca | 25517 |
| 302 | tatacatgggcttggatccatgtctgatgtactgtgtgcagtggaagacTCGGAAGGCCAGGCCACCCAAGAAA | 25341 | TCCCGAGAggaaagcag | 25518 |
| 303 | tgtggctggcctgctttcctctcgggatttcttgggtggcctggccttcCGAGTCTTCCACTGCACACAGTACA | 25342 | TCAGACATggatccaag | 25519 |
| 304 | tatacatgggcttggatccatgtctgatgtactgtgtgcagtggaagacTCGGAAGGCCAGGCCACCCAAGAAA | 25343 | TCCCGAGAggaaagcag | 25520 |
| 305 | tgtggctggcctgctttcctctcgggatttcttgggtggcctggccttcCGAGTCTTCCACTGCACACAGTACAT | 25344 | CAGACATGgatccaagc | 25521 |
| 306 | tatacatgggcttggatccatgtctgatgtactgtgtgcagtggaagacTCGGAAGGCCAGGCCACCCAAGAAAT | 25345 | CCCGAGAGgaaagcagg | 25522 |
| 308 | tgtggctggcctgctttcctctcgggatttcttgggtggcctggccttcCGAGTCTTCCACTGCACACAGTACATC | 25346 | AGACATGGatccaagcc | 25523 |
| 309 | tatacatgggcttggatccatgtctgatgtactgtgtgcagtggaagacTCGGAAGGCCAGGCCACCCAAGAAATC | 25347 | CCGAGAGGaaagcaggc | 25524 |
| 310 | tgtggctggcctgctttcctctcgggatttcttgggtggcctggccttcCGAGTCTTCCACTGCACACAGTACATCA | 25348 | GACATGGAtccaagccc | 25525 |
| 314 | tgtggctggcctgctttcctctcgggatttcttgggtggcctggccttcCGAGTCTTCCACTGCACACAGTACATCA | 25349 | GACATGGAtccaagccc | 25526 |
| 315 | tatacatgggcttggatccatgtctgatgtactgtgtgcagtggaagacTCGGAAGGCCAGGCCACCCAAGAAATCC | 25350 | CGAGAGGAaagcaggcc | 25527 |
| 316 | tgtggctggcctgctttcctctcgggatttcttgggtggcctggccttcCGAGTCTTCCACTGCACACAGTACATCA | 25351 | GACATGGAtccaagccc | 25528 |
| 317 | tgtggctggcctgctttcctctcgggatttcttgggtggcctggccttcCGAGTCTTCCACTGCACACAGTACATCA | 25352 | GACATGGAtccaagccc | 25529 |
| 321 | tgtggctggcctgctttcctctcgggatttcttgggtggcctggccttcCGAGTCTTCCACTGCACACAGTACATCAG | 25353 | ACATGGATccaagccca | 25530 |
| 322 | tgtggctggcctgctttcctctcgggatttcttgggtggcctggccttcCGAGTCTTCCACTGCACACAGTACATCAG | 25354 | ACATGGATccaagccca | 25531 |
| 323 | tatacatgggcttggatccatgtctgatgtactgtgtgcagtggaagacTCGGAAGGCCAGGCCACCCAAGAAATCCC | 25355 | GAGAGGAAagcaggcca | 25532 |
| 324 | tatacatgggcttggatccatgtctgatgtactgtgtgcagtggaagacTCGGAAGGCCAGGCCACCCAAGAAATCCC | 25356 | GAGAGGAAagcaggcca | 25533 |

TABLE 3B-continued

Exemplary RT sequence (heterologous object sequence) and PBS sequence pairs Table 3B provides exemplified PBS sequences and heterologous object sequences (reverse transcription template regions) of a template RNA for correcting the pathogenic R261Q mutation in PAH. The gRNA spacers from Table 1B were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1B, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 325 | tatacatgggcttggatccatgtctgatgtactgtgtgcagtggaagacTCGGAAGGCCAGGCCACCCAAGAAATCCC | 25357 | GAGAGGAAagcaggcca | 25534 |
| 327 | tgtggctggcctgctttcctctcgggatttcttgggtggcctggccttcCGAGTCTTCCACTGCACACAGTACATCAGA | 25358 | CATGGATCcaagcccat | 25535 |
| 329 | tatacatgggcttggatccatgtctgatgtactgtgtgcagtggaagacTCGGAAGGCCAGGCCACCCAAGAAATCCCG | 25359 | AGAGGAAAgcaggccag | 25536 |
| 332 | tgtggctggcctgctttcctctcgggatttcttgggtggcctggccttcCGAGTCTTCCACTGCACACAGTACATCAGAC | 25360 | ATGGATCCaagcccatg | 25537 |
| 335 | tatacatgggcttggatccatgtctgatgtactgtgtgcagtggaagacTCGGAAGGCCAGGCCACCCAAGAAATCCCGA | 25361 | GAGGAAAGcaggccagc | 25538 |
| 339 | tgtggctggcctgctttcctctcgggatttcttgggtggcctggccttcCGAGTCTTCCACTGCACACAGTACATCAGAC | 25362 | ATGGATCCaagcccatg | 25539 |
| 341 | tatacatgggcttggatccatgtctgatgtactgtgtgcagtggaagacTCGGAAGGCCAGGCCACCCAAGAAATCCCGA | 25363 | GAGGAAAGcaggccagc | 25540 |
| 350 | tgtggctggcctgctttcctctcgggatttcttgggtggcctggccttcCGAGTCTTCCACTGCACACAGTACATCAGACA | 25364 | TGGATCCAagcccatgt | 25541 |
| 351 | tgtggctggcctgctttcctctcgggatttcttgggtggcctggccttcCGAGTCTTCCACTGCACACAGTACATCAGACA | 25365 | TGGATCCAagcccatgt | 25542 |
| 354 | tatacatgggcttggatccatgtctgatgtactgtgtgcagtggaagacTCGGAAGGCCAGGCCACCCAAGAAATCCCGAG | 25366 | AGGAAAGCaggccagcc | 25543 |
| 355 | tatacatgggcttggatccatgtctgatgtactgtgtgcagtggaagacTCGGAAGGCCAGGCCACCCAAGAAATCCCGAG | 25367 | AGGAAAGCaggccagcc | 25544 |
| 358 | tatacatgggcttggatccatgtctgatgtactgtgtgcagtggaagacTCGGAAGGCCAGGCCACCCAAGAAATCCCGAG | 25368 | AGGAAAGCaggccagcc | 25545 |
| 359 | tatacatgggcttggatccatgtctgatgtactgtgtgcagtggaagacTCGGAAGGCCAGGCCACCCAAGAAATCCCGAG | 25369 | AGGAAAGCaggccagcc | 25546 |

TABLE 3C

Exemplary RT sequence (heterologous object sequence) and PBS sequence pairs
Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 3 | aggccaggccacccaagaaatcccgagaggaaagcaggccagccacaggTC | 25547 | GGAGGCGGa aaccagtg | 25732 |
| 4 | aggccaggccacccaagaaatcccgagaggaaagcaggccagccacaggTC | 25548 | GGAGGCGGa aaccagtg | 25733 |
| 5 | ttgagttttctttcttcttttcatcccagcttgcactggtttccgcctcCGA | 25549 | CCTGTGGCtg gcctgct | 25734 |
| 6 | ttgagttttctttcttcttttcatcccagcttgcactggtttccgcctcCGA | 25550 | CCTGTGGCtg gcctgct | 25735 |
| 9 | ttgagttttctttcttcttttcatcccagcttgcactggtttccgcctcCGA | 25551 | CCTGTGGCtg gcctgct | 25736 |
| 10 | ttgagttttctttcttcttttcatcccagcttgcactggtttccgcctcCGA | 25552 | CCTGTGGCtg gcctgct | 25737 |
| 11 | aggccaggccacccaagaaatcccgagaggaaagcaggccagccacaggTCG | 25553 | GAGGCGGAa accagtgc | 25738 |
| 12 | ttgagttttctttcttcttttcatcccagcttgcactggtttccgcctcCGA | 25554 | CCTGTGGCtg gcctgct | 25739 |
| 13 | ttgagttttctttcttcttttcatcccagcttgcactggtttccgcctcCGA | 25555 | CCTGTGGCtg gcctgct | 25740 |
| 14 | ttgagttttctttcttcttttcatcccagcttgcactggtttccgcctcCGAC | 25556 | CTGTGGCTg gcctgctt | 25741 |
| 15 | ttgagttttctttcttcttttcatcccagcttgcactggtttccgcctcCGAC | 25557 | CTGTGGCTg gcctgctt | 25742 |
| 17 | ttgagttttctttcttcttttcatcccagcttgcactggtttccgcctcCGAC | 25558 | CTGTGGCTg gcctgctt | 25743 |
| 21 | ttgagttttctttcttcttttcatcccagcttgcactggtttccgcctcCGAC | 25559 | CTGTGGCTg gcctgctt | 25744 |
| 22 | aggccaggccacccaagaaatcccgagaggaaagcaggccagccacaggTCGG | 25560 | AGGCGGAAa ccagtgca | 25745 |
| 25 | ttgagttttctttcttcttttcatcccagcttgcactggtttccgcctcCGACC | 25561 | TGTGGCTGg cctgcttt | 25746 |
| 26 | ttgagttttctttcttcttttcatcccagcttgcactggtttccgcctcCGACC | 25562 | TGTGGCTGg cctgcttt | 25747 |
| 29 | ttgagttttctttcttcttttcatcccagcttgcactggtttccgcctcCGACC | 25563 | TGTGGCTGg cctgcttt | 25748 |
| 30 | ttgagttttctttcttcttttcatcccagcttgcactggtttccgcctcCGACC | 25564 | TGTGGCTGg cctgcttt | 25749 |
| 33 | ttgagttttctttcttcttttcatcccagcttgcactggtttccgcctcCGACC | 25565 | TGTGGCTGg cctgcttt | 25750 |
| 34 | ttgagttttctttcttcttttcatcccagcttgcactggtttccgcctcCGACC | 25566 | TGTGGCTGg cctgcttt | 25751 |

TABLE 3C-continued

Exemplary RT sequence (heterologous object sequence) and PBS sequence pairs
Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 37 | aggccaggccacccaagaaatcccgagaggaaagcaggccagccacaggTCGGA | 25567 | GGCGGAAAc cagtgcaa | 25752 |
| 42 | ttgagttttctttcttcttttcatcccagcttgcactggtttccgcctcCGACCT | 25568 | GTGGCTGGc ctgctttc | 25753 |
| 43 | ttgagttttctttcttcttttcatcccagcttgcactggtttccgcctcCGACCT | 25569 | GTGGCTGGc ctgctttc | 25754 |
| 44 | ttgagttttctttcttcttttcatcccagcttgcactggtttccgcctcCGACCT | 25570 | GTGGCTGGc ctgctttc | 25755 |
| 45 | ttgagttttctttcttcttttcatcccagcttgcactggtttccgcctcCGACCT | 25571 | GTGGCTGGc ctgctttc | 25756 |
| 48 | ttgagttttctttcttcttttcatcccagcttgcactggtttccgcctcCGACCT | 25572 | GTGGCTGGc ctgctttc | 25757 |
| 49 | ttgagttttctttcttcttttcatcccagcttgcactggtttccgcctcCGACCT | 25573 | GTGGCTGGc ctgctttc | 25758 |
| 50 | aggccaggccacccaagaaatcccgagaggaaagcaggccagccacaggTCGGAG | 25574 | GCGGAAACC agtgcaag | 25759 |
| 51 | aggccaggccacccaagaaatcccgagaggaaagcaggccagccacaggTCGGAG | 25575 | GCGGAAACC agtgcaag | 25760 |
| 52 | aggccaggccacccaagaaatcccgagaggaaagcaggccagccacaggTCGGAG | 25576 | GCGGAAACC agtgcaag | 25761 |
| 57 | aggccaggccacccaagaaatcccgagaggaaagcaggccagccacaggTCGGAGG | 25577 | CGGAAACCa gtgcaagc | 25762 |
| 58 | ttgagttttctttcttcttttcatcccagcttgcactggtttccgcctcCGACCTG | 25578 | TGGCTGGCct gctttcc | 25763 |
| 59 | ttgagttttctttcttcttttcatcccagcttgcactggtttccgcctcCGACCTG | 25579 | TGGCTGGCct gctttcc | 25764 |
| 60 | aggccaggccacccaagaaatcccgagaggaaagcaggccagccacaggTCGGAGG | 25580 | CGGAAACCa gtgcaagc | 25765 |
| 61 | aggccaggccacccaagaaatcccgagaggaaagcaggccagccacaggTCGGAGG | 25581 | CGGAAACCa gtgcaagc | 25766 |
| 62 | aggccaggccacccaagaaatcccgagaggaaagcaggccagccacaggTCGGAGG | 25582 | CGGAAACCa gtgcaagc | 25767 |
| 64 | aggccaggccacccaagaaatcccgagaggaaagcaggccagccacaggTCGGAGGC | 25583 | GGAAACCAg tgcaagct | 25768 |
| 65 | ttgagttttctttcttcttttcatcccagcttgcactggtttccgcctcCGACCTGT | 25584 | GGCTGGCCt gctttcct | 25769 |
| 69 | ttgagttttctttcttcttttcatcccagcttgcactggtttccgcctcCGACCTGT | 25585 | GGCTGGCCt gctttcct | 25770 |
| 70 | aggccaggccacccaagaaatcccgagaggaaagcaggccagccacaggTCGGAGGC | 25586 | GGAAACCAg tgcaagct | 25771 |

TABLE 3C-continued

Exemplary RT sequence (heterologous object sequence) and PBS sequence pairs Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 76 | ttgagttttctttcttcttttcatcccagcttgcactggtttccgcctcCGACCTGTG | 25587 | GCTGGCCTg ctttcctc | 25772 |
| 77 | ttgagttttctttcttcttttcatcccagcttgcactggtttccgcctcCGACCTGTG | 25588 | GCTGGCCTg ctttcctc | 25773 |
| 80 | ttgagttttctttcttcttttcatcccagcttgcactggtttccgcctcCGACCTGTG | 25589 | GCTGGCCTg ctttcctc | 25774 |
| 81 | ttgagttttctttcttcttttcatcccagcttgcactggtttccgcctcCGACCTGTG | 25590 | GCTGGCCTg ctttcctc | 25775 |
| 84 | aggccaggccacccaagaaatcccgagaggaaagcaggccagccacaggTCGGAGGC G | 25591 | GAAACCAGt gcaagctg | 25776 |
| 86 | ttgagttttctttcttcttttcatcccagcttgcactggtttccgcctcCGACCTGTGG | 25592 | CTGGCCTGct ttcctct | 25777 |
| 87 | ttgagttttctttcttcttttcatcccagcttgcactggtttccgcctcCGACCTGTGG | 25593 | CTGGCCTGct ttcctct | 25778 |
| 90 | ttgagttttctttcttcttttcatcccagcttgcactggtttccgcctcCGACCTGTGG | 25594 | CTGGCCTGct ttcctct | 25779 |
| 91 | ttgagttttctttcttcttttcatcccagcttgcactggtttccgcctcCGACCTGTGG | 25595 | CTGGCCTGct ttcctct | 25780 |
| 92 | aggccaggccacccaagaaatcccgagaggaaagcaggccagccacaggTCGGAGGC GG | 25596 | AAACCAGTg caagctgg | 25781 |
| 93 | aggccaggccacccaagaaatcccgagaggaaagcaggccagccacaggTCGGAGGC GG | 25597 | AAACCAGTg caagctgg | 25782 |
| 96 | aggccaggccacccaagaaatcccgagaggaaagcaggccagccacaggTCGGAGGC GGA | 25598 | AACCAGTGc aagctggg | 25783 |
| 97 | ttgagttttctttcttcttttcatcccagcttgcactggtttccgcctcCGACCTGTGGC | 25599 | TGGCCTGCtt tcctctc | 25784 |
| 98 | ttgagttttctttcttcttttcatcccagcttgcactggtttccgcctcCGACCTGTGGC | 25600 | TGGCCTGCtt tcctctc | 25785 |
| 99 | ttgagttttctttcttcttttcatcccagcttgcactggtttccgcctcCGACCTGTGGC | 25601 | TGGCCTGCtt tcctctc | 25786 |
| 102 | ttgagttttctttcttcttttcatcccagcttgcactggtttccgcctcCGACCTGTGGC | 25602 | TGGCCTGCtt tcctctc | 25787 |
| 103 | ttgagttttctttcttcttttcatcccagcttgcactggtttccgcctcCGACCTGTGGC | 25603 | TGGCCTGCtt tcctctc | 25788 |
| 104 | aggccaggccacccaagaaatcccgagaggaaagcaggccagccacaggTCGGAGGC GGA | 25604 | AACCAGTGc aagctggg | 25789 |
| 105 | aggccaggccacccaagaaatcccgagaggaaagcaggccagccacaggTCGGAGGC GGA | 25605 | AACCAGTGc aagctggg | 25790 |

TABLE 3C-continued

Exemplary RT sequence (heterologous object sequence) and PBS sequence pairs
Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 106 | aggccaggccacccaagaaatcccgagaggaaagcaggccagccacaggTCGGAGGCGGA | 25606 | AACCAGTGcaagctggg | 25791 |
| 107 | aggccaggccacccaagaaatcccgagaggaaagcaggccagccacaggTCGGAGGCGGA | 25607 | AACCAGTGcaagctggg | 25792 |
| 108 | ttgagttttctttcttcttttcatcccagcttgcactggtttccgcctcCGACCTGTGGCT | 25608 | GGCCTGCTttcctctcg | 25793 |
| 109 | aggccaggccacccaagaaatcccgagaggaaagcaggccagccacaggTCGGAGGCGGAA | 25609 | ACCAGTGCaagctggga | 25794 |
| 112 | ttgagttttctttcttcttttcatcccagcttgcactggtttccgcctcCGACCTGTGGCT | 25610 | GGCCTGCTttcctctcg | 25795 |
| 114 | aggccaggccacccaagaaatcccgagaggaaagcaggccagccacaggTCGGAGGCGGAA | 25611 | ACCAGTGCaagctggga | 25796 |
| 121 | aggccaggccacccaagaaatcccgagaggaaagcaggccagccacaggTCGGAGGCGGAAA | 25612 | CCAGTGCAagctgggat | 25797 |
| 122 | aggccaggccacccaagaaatcccgagaggaaagcaggccagccacaggTCGGAGGCGGAAA | 25613 | CCAGTGCAagctgggat | 25798 |
| 123 | ttgagttttctttcttcttttcatcccagcttgcactggtttccgcctcCGACCTGTGGCTG | 25614 | GCCTGCTTtcctctcgg | 25799 |
| 124 | aggccaggccacccaagaaatcccgagaggaaagcaggccagccacaggTCGGAGGCGGAAA | 25615 | CCAGTGCAagctgggat | 25800 |
| 126 | aggccaggccacccaagaaatcccgagaggaaagcaggccagccacaggTCGGAGGCGGAAAC | 25616 | CAGTGCAAgctgggatg | 25801 |
| 127 | ttgagttttctttcttcttttcatcccagcttgcactggtttccgcctcCGACCTGTGGCTGG | 25617 | CCTGCTTTcctctcggg | 25802 |
| 128 | aggccaggccacccaagaaatcccgagaggaaagcaggccagccacaggTCGGAGGCGGAAAC | 25618 | CAGTGCAAgctgggatg | 25803 |
| 129 | ttgagttttctttcttcttttcatcccagcttgcactggtttccgcctcCGACCTGTGGCTGG | 25619 | CCTGCTTTcctctcggg | 25804 |
| 130 | ttgagttttctttcttcttttcatcccagcttgcactggtttccgcctcCGACCTGTGGCTGG | 25620 | CCTGCTTTcctctcggg | 25805 |
| 131 | aggccaggccacccaagaaatcccgagaggaaagcaggccagccacaggTCGGAGGCGGAAAC | 25621 | CAGTGCAAgctgggatg | 25806 |
| 132 | ttgagttttctttcttcttttcatcccagcttgcactggtttccgcctcCGACCTGTGGCTGGC | 25622 | CTGCTTTCctctcggga | 25807 |
| 136 | ttgagttttctttcttcttttcatcccagcttgcactggtttccgcctcCGACCTGTGGCTGGC | 25623 | CTGCTTTCctctcggga | 25808 |
| 137 | aggccaggccacccaagaaatcccgagaggaaagcaggccagccacaggTCGGAGGCGGAAACC | 25624 | AGTGCAAGctgggatga | 25809 |
| 141 | ttgagttttctttcttcttttcatcccagcttgcactggtttccgcctcCGACCTGTGGCTGGCC | 25625 | TGCTTTCCtctcgggat | 25810 |

TABLE 3C-continued

Exemplary RT sequence (heterologous object sequence) and PBS sequence pairs
Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 142 | ttgagttttctttcttcttttcatcccagcttgcactggtttccgcctcCGACCTGTGGCTGGCC | 25626 | TGCTTTCCtctcgggat | 25811 |
| 143 | aggccaggccacccaagaaatcccgagaggaaagcaggccagccacaggTCGGAGGCGGAAACCA | 25627 | GTGCAAGCtgggatgaa | 25812 |
| 144 | ttgagttttctttcttcttttcatcccagcttgcactggtttccgcctcCGACCTGTGGCTGGCC | 25628 | TGCTTTCCtctcgggat | 25813 |
| 145 | aggccaggccacccaagaaatcccgagaggaaagcaggccagccacaggTCGGAGGCGGAAACCA | 25629 | GTGCAAGCtgggatgaa | 25814 |
| 148 | ttgagttttctttcttcttttcatcccagcttgcactggtttccgcctcCGACCTGTGGCTGGCCT | 25630 | GCTTTCCTctcgggatt | 25815 |
| 149 | aggccaggccacccaagaaatcccgagaggaaagcaggccagccacaggTCGGAGGCGGAAACCAG | 25631 | TGCAAGCTgggatgaaa | 25816 |
| 150 | ttgagttttctttcttcttttcatcccagcttgcactggtttccgcctcCGACCTGTGGCTGGCCT | 25632 | GCTTTCCTctcgggatt | 25817 |
| 151 | ttgagttttctttcttcttttcatcccagcttgcactggtttccgcctcCGACCTGTGGCTGGCCT | 25633 | GCTTTCCTctcgggatt | 25818 |
| 152 | aggccaggccacccaagaaatcccgagaggaaagcaggccagccacaggTCGGAGGCGGAAACCAG | 25634 | TGCAAGCTgggatgaaa | 25819 |
| 153 | ttgagttttctttcttcttttcatcccagcttgcactggtttccgcctcCGACCTGTGGCTGGCCT | 25635 | GCTTTCCTctcgggatt | 25820 |
| 154 | aggccaggccacccaagaaatcccgagaggaaagcaggccagccacaggTCGGAGGCGGAAACCAG | 25636 | TGCAAGCTgggatgaaa | 25821 |
| 155 | ttgagttttctttcttcttttcatcccagcttgcactggtttccgcctcCGACCTGTGGCTGGCCTG | 25637 | CTTTCCTCtcgggattt | 25822 |
| 156 | aggccaggccacccaagaaatcccgagaggaaagcaggccagccacaggTCGGAGGCGGAAACCAGT | 25638 | GCAAGCTGggatgaaaa | 25823 |
| 160 | aggccaggccacccaagaaatcccgagaggaaagcaggccagccacaggTCGGAGGCGGAAACCAGT | 25639 | GCAAGCTGggatgaaaa | 25824 |
| 161 | ttgagttttctttcttcttttcatcccagcttgcactggtttccgcctcCGACCTGTGGCTGGCCTG | 25640 | CTTTCCTCtcgggattt | 25825 |
| 167 | aggccaggccacccaagaaatcccgagaggaaagcaggccagccacaggTCGGAGGCGGAAACCAGTG | 25641 | CAAGCTGGgatgaaaag | 25826 |
| 168 | aggccaggccacccaagaaatcccgagaggaaagcaggccagccacaggTCGGAGGCGGAAACCAGTG | 25642 | CAAGCTGGgatgaaaag | 25827 |
| 171 | aggccaggccacccaagaaatcccgagaggaaagcaggccagccacaggTCGGAGGCGGAAACCAGTG | 25643 | CAAGCTGGgatgaaaag | 25828 |
| 172 | ttgagttttctttcttcttttcatcccagcttgcactggtttccgcctcCGACCTGTGGCTGGCCTGC | 25644 | TTTCCTCTcgggatttc | 25829 |

TABLE 3C-continued

Exemplary RT sequence (heterologous object sequence) and PBS sequence pairs Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 175 | aggccaggccacccaagaaatcccgagaggaaagcaggccagccacaggTCGGAGGCGGAAACCAGTG | 25645 | CAAGCTGGgatgaaaag | 25830 |
| 179 | ttgagttttctttcttcttttcatcccagcttgcactggtttccgcctcCGACCTGTGGCTGGCCTGC | 25646 | TTTCCTCTcgggatttc | 25831 |
| 183 | aggccaggccacccaagaaatcccgagaggaaagcaggccagccacaggTCGGAGGCGGAAACCAGTGC | 25647 | AAGCTGGGatgaaaaga | 25832 |
| 184 | aggccaggccacccaagaaatcccgagaggaaagcaggccagccacaggTCGGAGGCGGAAACCAGTGC | 25648 | AAGCTGGGatgaaaaga | 25833 |
| 187 | ttgagttttctttcttcttttcatcccagcttgcactggtttccgcctcCGACCTGTGGCTGGCCTGCT | 25649 | TTCCTCTCgggatttct | 25834 |
| 188 | ttgagttttctttcttcttttcatcccagcttgcactggtttccgcctcCGACCTGTGGCTGGCCTGCT | 25650 | TTCCTCTCgggatttct | 25835 |
| 191 | ttgagttttctttcttcttttcatcccagcttgcactggtttccgcctcCGACCTGTGGCTGGCCTGCT | 25651 | TTCCTCTCgggatttct | 25836 |
| 194 | aggccaggccacccaagaaatcccgagaggaaagcaggccagccacaggTCGGAGGCGGAAACCAGTGC | 25652 | AAGCTGGGatgaaaaga | 25837 |
| 195 | aggccaggccacccaagaaatcccgagaggaaagcaggccagccacaggTCGGAGGCGGAAACCAGTGC | 25653 | AAGCTGGGatgaaaaga | 25838 |
| 196 | ttgagttttctttcttcttttcatcccagcttgcactggtttccgcctcCGACCTGTGGCTGGCCTGCT | 25654 | TTCCTCTCgggatttct | 25839 |
| 199 | ttgagttttctttcttcttttcatcccagcttgcactggtttccgcctcCGACCTGTGGCTGGCCTGCT | 25655 | TTCCTCTCgggatttct | 25840 |
| 203 | ttgagttttctttcttcttttcatcccagcttgcactggtttccgcctcCGACCTGTGGCTGGCCTGCTT | 25656 | TCCTCTCGggatttctt | 25841 |
| 204 | aggccaggccacccaagaaatcccgagaggaaagcaggccagccacaggTCGGAGGCGGAAACCAGTGCA | 25657 | AGCTGGGAtgaaaagaa | 25842 |
| 205 | aggccaggccacccaagaaatcccgagaggaaagcaggccagccacaggTCGGAGGCGGAAACCAGTGCA | 25658 | AGCTGGGAtgaaaagaa | 25843 |
| 206 | aggccaggccacccaagaaatcccgagaggaaagcaggccagccacaggTCGGAGGCGGAAACCAGTGCA | 25659 | AGCTGGGAtgaaaagaa | 25844 |
| 207 | ttgagttttctttcttcttttcatcccagcttgcactggtttccgcctcCGACCTGTGGCTGGCCTGCTT | 25660 | TCCTCTCGggatttctt | 25845 |
| 208 | ttgagttttctttcttcttttcatcccagcttgcactggtttccgcctcCGACCTGTGGCTGGCCTGCTT | 25661 | TCCTCTCGggatttctt | 25846 |
| 211 | ttgagttttctttcttcttttcatcccagcttgcactggtttccgcctcCGACCTGTGGCTGGCCTGCTT | 25662 | TCCTCTCGggatttctt | 25847 |
| 212 | ttgagttttctttcttcttttcatcccagcttgcactggtttccgcctcCGACCTGTGGCTGGCCTGCTT | 25663 | TCCTCTCGggatttctt | 25848 |
| 213 | aggccaggccacccaagaaatcccgagaggaaagcaggccagccacaggTCGGAGGCGGAAACCAGTGCA | 25664 | AGCTGGGAtgaaaagaa | 25849 |

TABLE 3C-continued

Exemplary RT sequence (heterologous object sequence) and PBS sequence pairs Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 214 | ttgagttttctttcttcttttcatcccagcttgcactggtttccgcctcCGACCTGTGGCTGGCCTGCTT | 25665 | TCCTCTCGggatttctt | 25850 |
| 215 | ttgagttttctttcttcttttcatcccagcttgcactggtttccgcctcCGACCTGTGGCTGGCCTGCTT | 25666 | TCCTCTCGggatttctt | 25851 |
| 217 | ttgagttttctttcttcttttcatcccagcttgcactggtttccgcctcCGACCTGTGGCTGGCCTGCTTT | 25667 | CCTCTCGGgatttcttg | 25852 |
| 218 | ttgagttttctttcttcttttcatcccagcttgcactggtttccgcctcCGACCTGTGGCTGGCCTGCTTT | 25668 | CCTCTCGGgatttcttg | 25853 |
| 219 | aggccaggccacccaagaaatcccgagaggaaagcaggccagccacaggTCGGAGGCGGAAACCAGTGCAA | 25669 | GCTGGGATgaaaagaag | 25854 |
| 220 | ttgagttttctttcttcttttcatcccagcttgcactggtttccgcctcCGACCTGTGGCTGGCCTGCTTT | 25670 | CCTCTCGGgatttcttg | 25855 |
| 224 | ttgagttttctttcttcttttcatcccagcttgcactggtttccgcctcCGACCTGTGGCTGGCCTGCTTTC | 25671 | CTCTCGGGatttcttgg | 25856 |
| 225 | ttgagttttctttcttcttttcatcccagcttgcactggtttccgcctcCGACCTGTGGCTGGCCTGCTTTC | 25672 | CTCTCGGGatttcttgg | 25857 |
| 229 | ttgagttttctttcttcttttcatcccagcttgcactggtttccgcctcCGACCTGTGGCTGGCCTGCTTTC | 25673 | CTCTCGGGatttcttgg | 25858 |
| 230 | aggccaggccacccaagaaatcccgagaggaaagcaggccagccacaggTCGGAGGCGGAAACCAGTGCAAG | 25674 | CTGGGATGaaaagaaga | 25859 |
| 236 | ttgagttttctttcttcttttcatcccagcttgcactggtttccgcctcCGACCTGTGGCTGGCCTGCTTTCC | 25675 | TCTCGGGAtttcttggg | 25860 |
| 237 | ttgagttttctttcttcttttcatcccagcttgcactggtttccgcctcCGACCTGTGGCTGGCCTGCTTTCC | 25676 | TCTCGGGAtttcttggg | 25861 |
| 238 | aggccaggccacccaagaaatcccgagaggaaagcaggccagccacaggTCGGAGGCGGAAACCAGTGCAAGC | 25677 | TGGGATGAaaagaagaa | 25862 |
| 242 | aggccaggccacccaagaaatcccgagaggaaagcaggccagccacaggTCGGAGGCGGAAACCAGTGCAAGC | 25678 | TGGGATGAaaagaagaa | 25863 |
| 243 | aggccaggccacccaagaaatcccgagaggaaagcaggccagccacaggTCGGAGGCGGAAACCAGTGCAAGC | 25679 | TGGGATGAaaagaagaa | 25864 |
| 244 | aggccaggccacccaagaaatcccgagaggaaagcaggccagccacaggTCGGAGGCGGAAACCAGTGCAAGC | 25680 | TGGGATGAaaagaagaa | 25865 |
| 249 | ttgagttttctttcttcttttcatcccagcttgcactggtttccgcctcCGACCTGTGGCTGGCCTGCTTTCCT | 25681 | CTCGGGATttcttgggt | 25866 |
| 254 | aggccaggccacccaagaaatcccgagaggaaagcaggccagccacaggTCGGAGGCGGAAACCAGTGCAAGCT | 25682 | GGGATGAAaagaagaaa | 25867 |
| 255 | aggccaggccacccaagaaatcccgagaggaaagcaggccagccacaggTCGGAGGCGGAAACCAGTGCAAGCT | 25683 | GGGATGAAaagaagaaa | 25868 |
| 256 | ttgagttttctttcttcttttcatcccagcttgcactggtttccgcctcCGACCTGTGGCTGGCCTGCTTTCCT | 25684 | CTCGGGATttcttgggt | 25869 |

TABLE 3C-continued

Exemplary RT sequence (heterologous object sequence) and PBS sequence pairs Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 257 | ttgagttttctttcttcttttcatcccagcttgcactggtttccgcctcCGACCTGTGGCTGGCCTGCTTTCCT | 25685 | CTCGGGATttcttgggt | 25870 |
| 258 | ttgagttttctttcttcttttcatcccagcttgcactggtttccgcctcCGACCTGTGGCTGGCCTGCTTTCCT | 25686 | CTCGGGATttcttgggt | 25871 |
| 260 | ttgagttttctttcttcttttcatcccagcttgcactggtttccgcctcCGACCTGTGGCTGGCCTGCTTTCCTC | 25687 | TCGGGATTtcttgggtg | 25872 |
| 261 | ttgagttttctttcttcttttcatcccagcttgcactggtttccgcctcCGACCTGTGGCTGGCCTGCTTTCCTC | 25688 | TCGGGATTtcttgggtg | 25873 |
| 263 | aggccaggccacccaagaaatcccgagaggaaagcaggccagccacaggTCGGAGGCGGAAACCAGTGCAAGCTG | 25689 | GGATGAAAagaagaaag | 25874 |
| 264 | aggccaggccacccaagaaatcccgagaggaaagcaggccagccacaggTCGGAGGCGGAAACCAGTGCAAGCTG | 25690 | GGATGAAAagaagaaag | 25875 |
| 269 | ttgagttttctttcttcttttcatcccagcttgcactggtttccgcctcCGACCTGTGGCTGGCCTGCTTTCCTCT | 25691 | CGGGATTTcttgggtgg | 25876 |
| 270 | ttgagttttctttcttcttttcatcccagcttgcactggtttccgcctcCGACCTGTGGCTGGCCTGCTTTCCTCT | 25692 | CGGGATTTcttgggtgg | 25877 |
| 274 | ttgagttttctttcttcttttcatcccagcttgcactggtttccgcctcCGACCTGTGGCTGGCCTGCTTTCCTCT | 25693 | CGGGATTTcttgggtgg | 25878 |
| 275 | aggccaggccacccaagaaatcccgagaggaaagcaggccagccacaggTCGGAGGCGGAAACCAGTGCAAGCTGG | 25694 | GATGAAAAgaagaaaga | 25879 |
| 281 | ttgagttttctttcttcttttcatcccagcttgcactggtttccgcctcCGACCTGTGGCTGGCCTGCTTTCCTCTC | 25695 | GGGATTTCttgggtggc | 25880 |
| 282 | ttgagttttctttcttcttttcatcccagcttgcactggtttccgcctcCGACCTGTGGCTGGCCTGCTTTCCTCTC | 25696 | GGGATTTCttgggtggc | 25881 |
| 285 | ttgagttttctttcttcttttcatcccagcttgcactggtttccgcctcCGACCTGTGGCTGGCCTGCTTTCCTCTC | 25697 | GGGATTTCttgggtggc | 25882 |
| 286 | ttgagttttctttcttcttttcatcccagcttgcactggtttccgcctcCGACCTGTGGCTGGCCTGCTTTCCTCTC | 25698 | GGGATTTCttgggtggc | 25883 |
| 289 | ttgagttttctttcttcttttcatcccagcttgcactggtttccgcctcCGACCTGTGGCTGGCCTGCTTTCCTCTC | 25699 | GGGATTTCttgggtggc | 25884 |
| 290 | ttgagttttctttcttcttttcatcccagcttgcactggtttccgcctcCGACCTGTGGCTGGCCTGCTTTCCTCTC | 25700 | GGGATTTCttgggtggc | 25885 |
| 293 | aggccaggccacccaagaaatcccgagaggaaagcaggccagccacaggTCGGAGGCGGAAACCAGTGCAAGCTGGG | 25701 | ATGAAAAGaagaaagaa | 25886 |
| 297 | aggccaggccacccaagaaatcccgagaggaaagcaggccagccacaggTCGGAGGCGGAAACCAGTGCAAGCTGGG | 25702 | ATGAAAAGaagaaagaa | 25887 |
| 303 | ttgagttttctttcttcttttcatcccagcttgcactggtttccgcctcCGACCTGTGGCTGGCCTGCTTTCCTCTCG | 25703 | GGATTTCTtgggtggcc | 25888 |
| 304 | ttgagttttctttcttcttttcatcccagcttgcactggtttccgcctcCGACCTGTGGCTGGCCTGCTTTCCTCTCG | 25704 | GGATTTCTtgggtggcc | 25889 |

TABLE 3C-continued

Exemplary RT sequence (heterologous object sequence) and PBS sequence pairs Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 305 | ttgagttttctttcttcttttcatcccagcttgcactggtttccgcctcCGACCTGTGGCTGGCCTGCTTTCCTCTCG | 25705 | GGATTTCTtgggtggcc | 25890 |
| 306 | ttgagttttctttcttcttttcatcccagcttgcactggtttccgcctcCGACCTGTGGCTGGCCTGCTTTCCTCTCG | 25706 | GGATTTCTtgggtggcc | 25891 |
| 309 | ttgagttttctttcttcttttcatcccagcttgcactggtttccgcctcCGACCTGTGGCTGGCCTGCTTTCCTCTCG | 25707 | GGATTTCTtgggtggcc | 25892 |
| 310 | ttgagttttctttcttcttttcatcccagcttgcactggtttccgcctcCGACCTGTGGCTGGCCTGCTTTCCTCTCG | 25708 | GGATTTCTtgggtggcc | 25893 |
| 313 | aggccaggccacccaagaaatcccgagaggaaagcaggccagccacaggTCGGAGGCGGAAACCAGTGCAAGCTGGGA | 25709 | TGAAAAGAagaaagaaa | 25894 |
| 314 | aggccaggccacccaagaaatcccgagaggaaagcaggccagccacaggTCGGAGGCGGAAACCAGTGCAAGCTGGGA | 25710 | TGAAAAGAagaaagaaa | 25895 |
| 315 | ttgagttttctttcttcttttcatcccagcttgcactggtttccgcctcCGACCTGTGGCTGGCCTGCTTTCCTCTCG | 25711 | GGATTTCTtgggtggcc | 25896 |
| 319 | ttgagttttctttcttcttttcatcccagcttgcactggtttccgcctcCGACCTGTGGCTGGCCTGCTTTCCTCTCGG | 25712 | GATTTCTTgggtggcct | 25897 |
| 320 | ttgagttttctttcttcttttcatcccagcttgcactggtttccgcctcCGACCTGTGGCTGGCCTGCTTTCCTCTCGG | 25713 | GATTTCTTgggtggcct | 25898 |
| 322 | aggccaggccacccaagaaatcccgagaggaaagcaggccagccacaggTCGGAGGCGGAAACCAGTGCAAGCTGGGAT | 25714 | GAAAAGAAgaaagaaaa | 25899 |
| 323 | ttgagttttctttcttcttttcatcccagcttgcactggtttccgcctcCGACCTGTGGCTGGCCTGCTTTCCTCTCGG | 25715 | GATTTCTTgggtggcct | 25900 |
| 327 | ttgagttttctttcttcttttcatcccagcttgcactggtttccgcctcCGACCTGTGGCTGGCCTGCTTTCCTCTCGG | 25716 | GATTTCTTgggtggcct | 25901 |
| 328 | aggccaggccacccaagaaatcccgagaggaaagcaggccagccacaggTCGGAGGCGGAAACCAGTGCAAGCTGGGAT | 25717 | GAAAAGAAgaaagaaaa | 25902 |
| 329 | ttgagttttctttcttcttttcatcccagcttgcactggtttccgcctcCGACCTGTGGCTGGCCTGCTTTCCTCTCGG | 25718 | GATTTCTTgggtggcct | 25903 |
| 330 | aggccaggccacccaagaaatcccgagaggaaagcaggccagccacaggTCGGAGGCGGAAACCAGTGCAAGCTGGGAT | 25719 | GAAAAGAAgaaagaaaa | 25904 |
| 331 | aggccaggccacccaagaaatcccgagaggaaagcaggccagccacaggTCGGAGGCGGAAACCAGTGCAAGCTGGGAT | 25720 | GAAAAGAAgaaagaaaa | 25905 |
| 336 | ttgagttttctttcttcttttcatcccagcttgcactggtttccgcctcCGACCTGTGGCTGGCCTGCTTTCCTCTCGGG | 25721 | ATTTCTTGggtggcctg | 25906 |
| 337 | ttgagttttctttcttcttttcatcccagcttgcactggtttccgcctcCGACCTGTGGCTGGCCTGCTTTCCTCTCGGG | 25722 | ATTTCTTGggtggcctg | 25907 |
| 338 | aggccaggccacccaagaaatcccgagaggaaagcaggccagccacaggTCGGAGGCGGAAACCAGTGCAAGCTGGGATG | 25723 | AAAAGAAGaaagaaaac | 25908 |
| 341 | ttgagttttctttcttcttttcatcccagcttgcactggtttccgcctcCGACCTGTGGCTGGCCTGCTTTCCTCTCGGG | 25724 | ATTTCTTGggtggcctg | 25909 |

TABLE 3C-continued

Exemplary RT sequence (heterologous object sequence) and PBS sequence pairs Table 3C provides exemplified PBS sequences and heterologous object sequences (reverse transcription template regions) of a template RNA for correcting the pathogenic R243Q mutation in PAH. The gRNA spacers from Table 1C were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1C, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 342 | ttgagttttctttcttcttttcatcccagcttgcactggtttccgcctcCGACCTGTGGCTGG CCTGCTTTCCTCTCGGG | 25725 | ATTTCTTGgg tggcctg | 25910 |
| 343 | aggccaggccacccaagaaatcccgagaggaaagcaggccagccacaggTCGGAGGC GGAAACCAGTGCAAGCTGGGATG | 25726 | AAAAGAAG aaagaaaac | 25911 |
| 350 | ttgagttttctttcttcttttcatcccagcttgcactggtttccgcctcCGACCTGTGGCTGG CCTGCTTTCCTCTCGGGA | 25727 | TTTCTTGGgt ggcctgg | 25912 |
| 351 | ttgagttttctttcttcttttcatcccagcttgcactggtttccgcctcCGACCTGTGGCTGG CCTGCTTTCCTCTCGGGA | 25728 | TTTCTTGGgt ggcctgg | 25913 |
| 353 | ttgagttttctttcttcttttcatcccagcttgcactggtttccgcctcCGACCTGTGGCTGG CCTGCTTTCCTCTCGGGA | 25729 | TTTCTTGGgt ggcctgg | 25914 |
| 357 | ttgagttttctttcttcttttcatcccagcttgcactggtttccgcctcCGACCTGTGGCTGG CCTGCTTTCCTCTCGGGA | 25730 | TTTCTTGGgt ggcctgg | 25915 |
| 358 | aggccaggccacccaagaaatcccgagaggaaagcaggccagccacaggTCGGAGGC GGAAACCAGTGCAAGCTGGGATGA | 25731 | AAAGAAGA aagaaaact | 25916 |

TABLE 3D

Exemplary RT sequence (heterologous object sequence) and PBS sequence pairs Table 3D provides exemplified PBS sequences and heterologous object sequences (reverse transcription template regions) of a template RNA for correcting the pathogenic IVS10-11G > A mutation in PAH. The gRNA spacers from Table 1D were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1D, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 1 | gctccaggggagaagctttggcttctctgataagcagtactgtaggcccCC | 25917 | AAGTGAAAa gttattat | 26066 |
| 2 | gcagcagggaatactgatcctgatttaacagtgataataacttttcactTGG | 25918 | GGCCTACAgt actgctt | 26067 |
| 3 | gctccaggggagaagctttggcttctctgataagcagtactgtaggcccCCA | 25919 | AGTGAAAAg ttattatc | 26068 |
| 6 | gcagcagggaatactgatcctgatttaacagtgataataacttttcactTGG | 25920 | GGCCTACAgt actgctt | 26069 |

TABLE 3D-continued

Exemplary RT sequence (heterologous object sequence) and PBS sequence pairs Table 3D provides exemplified PBS sequences and heterologous object sequences (reverse transcription template regions) of a template RNA for correcting the pathogenic IVS10-11G > A mutation in PAH. The gRNA spacers from Table 1D were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1D, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 10 | gctccaggggggagaagctttggcttctctgataagcagtactgtaggcccCCA | 25921 | AGTGAAAAg ttattatc | 26070 |
| 12 | gcagcagggaatactgatcctgatttaacagtgataataacttttcactTGG | 25922 | GGCCTACAgt actgctt | 26071 |
| 16 | gctccaggggggagaagctttggcttctctgataagcagtactgtaggcccCCAA | 25923 | GTGAAAAGtt attatca | 26072 |
| 17 | gctccaggggggagaagctttggcttctctgataagcagtactgtaggcccCCAA | 25924 | GTGAAAAGtt attatca | 26073 |
| 20 | gctccaggggggagaagctttggcttctctgataagcagtactgtaggcccCCAA | 25925 | GTGAAAAGtt attatca | 26074 |
| 23 | gcagcagggaatactgatcctgatttaacagtgataataacttttcactTGGG | 25926 | GCCTACAGta ctgctta | 26075 |
| 24 | gcagcagggaatactgatcctgatttaacagtgataataacttttcactTGGG | 25927 | GCCTACAGta ctgctta | 26076 |
| 25 | gctccaggggggagaagctttggcttctctgataagcagtactgtaggcccCCAA | 25928 | GTGAAAAGtt attatca | 26077 |
| 28 | gctccaggggggagaagctttggcttctctgataagcagtactgtaggcccCCAA | 25929 | GTGAAAAGtt attatca | 26078 |
| 31 | gctccaggggggagaagctttggcttctctgataagcagtactgtaggcccCCAAG | 25930 | TGAAAAGTta ttatcac | 26079 |
| 32 | gctccaggggggagaagctttggcttctctgataagcagtactgtaggcccCCAAG | 25931 | TGAAAAGTta ttatcac | 26080 |
| 33 | gctccaggggggagaagctttggcttctctgataagcagtactgtaggcccCCAAG | 25932 | TGAAAAGTta ttatcac | 26081 |
| 34 | gcagcagggaatactgatcctgatttaacagtgataataacttttcactTGGGG | 25933 | CCTACAGTac tgcttat | 26082 |
| 39 | gctccaggggggagaagctttggcttctctgataagcagtactgtaggcccCCAAG | 25934 | TGAAAAGTta ttatcac | 26083 |
| 40 | gctccaggggggagaagctttggcttctctgataagcagtactgtaggcccCCAAG | 25935 | TGAAAAGTta ttatcac | 26084 |
| 43 | gctccaggggggagaagctttggcttctctgataagcagtactgtaggcccCCAAG | 25936 | TGAAAAGTta ttatcac | 26085 |
| 44 | gctccaggggggagaagctttggcttctctgataagcagtactgtaggcccCCAAG | 25937 | TGAAAAGTta ttatcac | 26086 |
| 47 | gcagcagggaatactgatcctgatttaacagtgataataacttttcactTGGGG | 25938 | CCTACAGTac tgcttat | 26087 |
| 48 | gctccaggggggagaagctttggcttctctgataagcagtactgtaggcccCCAAG | 25939 | TGAAAAGTta ttatcac | 26088 |
| 49 | gctccaggggggagaagctttggcttctctgataagcagtactgtaggcccCCAAG | 25940 | TGAAAAGTta ttatcac | 26089 |

TABLE 3D-continued

Exemplary RT sequence (heterologous object sequence) and PBS sequence pairs
Table 3D provides exemplified PBS sequences and heterologous object sequences (reverse transcription template regions) of a template RNA for correcting the pathogenic IVS10-11G > A mutation in PAH. The gRNA spacers from Table 1D were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1D, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 52 | gctccaggggggagaagctttggcttctctgataagcagtactgtaggccCCAAGT | 25941 | GAAAAGTTat tatcact | 26090 |
| 53 | gctccaggggggagaagctttggcttctctgataagcagtactgtaggccCCAAGT | 25942 | GAAAAGTTat tatcact | 26091 |
| 54 | gcagcagggaatactgatcctgatttaacagtgataataacttttcactTGGGGC | 25943 | CTACAGTAct gcttatc | 26092 |
| 55 | gcagcagggaatactgatcctgatttaacagtgataataacttttcactTGGGGC | 25944 | CTACAGTAct gcttatc | 26093 |
| 58 | gctccaggggggagaagctttggcttctctgataagcagtactgtaggccCCAAGT | 25945 | GAAAAGTTat tatcact | 26094 |
| 59 | gctccaggggggagaagctttggcttctctgataagcagtactgtaggccCCAAGT | 25946 | GAAAAGTTat tatcact | 26095 |
| 62 | gctccaggggggagaagctttggcttctctgataagcagtactgtaggccCCAAGT | 25947 | GAAAAGTTat tatcact | 26096 |
| 63 | gctccaggggggagaagctttggcttctctgataagcagtactgtaggccCCAAGT | 25948 | GAAAAGTTat tatcact | 26097 |
| 64 | gcagcagggaatactgatcctgatttaacagtgataataacttttcactTGGGGC | 25949 | CTACAGTAct gcttatc | 26098 |
| 67 | gcagcagggaatactgatcctgatttaacagtgataataacttttcactTGGGGCC | 25950 | TACAGTACtg cttatca | 26099 |
| 68 | gctccaggggggagaagctttggcttctctgataagcagtactgtaggccCCAAGTG | 25951 | AAAAGTTAtt atcactg | 26100 |
| 69 | gctccaggggggagaagctttggcttctctgataagcagtactgtaggccCCAAGTG | 25952 | AAAAGTTAtt atcactg | 26101 |
| 70 | gcagcagggaatactgatcctgatttaacagtgataataacttttcactTGGGGCC | 25953 | TACAGTACtg cttatca | 26102 |
| 71 | gctccaggggggagaagctttggcttctctgataagcagtactgtaggccCCAAGTG | 25954 | AAAAGTTAtt atcactg | 26103 |
| 74 | gctccaggggggagaagctttggcttctctgataagcagtactgtaggccCCAAGTGA | 25955 | AAAGTTATta tcactgt | 26104 |
| 75 | gcagcagggaatactgatcctgatttaacagtgataataacttttcactTGGGGCCT | 25956 | ACAGTACTg cttatcag | 26105 |
| 76 | gctccaggggggagaagctttggcttctctgataagcagtactgtaggccCCAAGTGA | 25957 | AAAGTTATta tcactgt | 26106 |
| 77 | gcagcagggaatactgatcctgatttaacagtgataataacttttcactTGGGGCCTA | 25958 | CAGTACTGct tatcaga | 26107 |
| 78 | gctccaggggggagaagctttggcttctctgataagcagtactgtaggccCCAAGTGAA | 25959 | AAGTTATTat cactgtt | 26108 |
| 79 | gcagcagggaatactgatcctgatttaacagtgataataacttttcactTGGGGCCTAC | 25960 | AGTACTGCtt atcagag | 26109 |

TABLE 3D-continued

Exemplary RT sequence (heterologous object sequence) and PBS sequence pairs
Table 3D provides exemplified PBS sequences and heterologous object sequences (reverse transcription template regions) of a template RNA for correcting the pathogenic IVS10-11G > A mutation in PAH. The gRNA spacers from Table 1D were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1D, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 83 | gcagcagggaatactgatcctgatttaacagtgataataacttttcactTGGGGCCTAC | 25961 | AGTACTGCttatcagag | 26110 |
| 84 | gctccaggggggagaagctttggcttctctgataagcagtactgtaggccCCAAGTGAAA | 25962 | AGTTATTAtcactgtta | 26111 |
| 85 | gcagcagggaatactgatcctgatttaacagtgataataacttttcactTGGGGCCTAC | 25963 | AGTACTGCttatcagag | 26112 |
| 86 | gcagcagggaatactgatcctgatttaacagtgataataacttttcactTGGGGCCTAC | 25964 | AGTACTGCttatcagag | 26113 |
| 87 | gcagcagggaatactgatcctgatttaacagtgataataacttttcactTGGGGCCTAC | 25965 | AGTACTGCttatcagag | 26114 |
| 90 | gcagcagggaatactgatcctgatttaacagtgataataacttttcactTGGGGCCTACA | 25966 | GTACTGCTtatcagaga | 26115 |
| 93 | gcagcagggaatactgatcctgatttaacagtgataataacttttcactTGGGGCCTACA | 25967 | GTACTGCTtatcagaga | 26116 |
| 94 | gcagcagggaatactgatcctgatttaacagtgataataacttttcactTGGGGCCTACA | 25968 | GTACTGCTtatcagaga | 26117 |
| 97 | gcagcagggaatactgatcctgatttaacagtgataataacttttcactTGGGGCCTACA | 25969 | GTACTGCTtatcagaga | 26118 |
| 98 | gcagcagggaatactgatcctgatttaacagtgataataacttttcactTGGGGCCTACA | 25970 | GTACTGCTtatcagaga | 26119 |
| 101 | gctccaggggggagaagctttggcttctctgataagcagtactgtaggccCCAAGTGAAAA | 25971 | GTTATTATcactgttaa | 26120 |
| 102 | gcagcagggaatactgatcctgatttaacagtgataataacttttcactTGGGGCCTACA | 25972 | GTACTGCTtatcagaga | 26121 |
| 103 | gcagcagggaatactgatcctgatttaacagtgataataacttttcactTGGGGCCTACA | 25973 | GTACTGCTtatcagaga | 26122 |
| 106 | gcagcagggaatactgatcctgatttaacagtgataataacttttcactTGGGGCCTACAG | 25974 | TACTGCTTatcagagaa | 26123 |
| 107 | gcagcagggaatactgatcctgatttaacagtgataataacttttcactTGGGGCCTACAG | 25975 | TACTGCTTatcagagaa | 26124 |
| 108 | gcagcagggaatactgatcctgatttaacagtgataataacttttcactTGGGGCCTACAG | 25976 | TACTGCTTatcagagaa | 26125 |
| 111 | gcagcagggaatactgatcctgatttaacagtgataataacttttcactTGGGGCCTACAG | 25977 | TACTGCTTatcagagaa | 26126 |
| 112 | gcagcagggaatactgatcctgatttaacagtgataataacttttcactTGGGGCCTACAG | 25978 | TACTGCTTatcagagaa | 26127 |
| 113 | gctccaggggggagaagctttggcttctctgataagcagtactgtaggccCCAAGTGAAAAG | 25979 | TTATTATCactgttaaa | 26128 |
| 114 | gctccaggggggagaagctttggcttctctgataagcagtactgtaggccCCAAGTGAAAAG | 25980 | TTATTATCactgttaaa | 26129 |

TABLE 3D-continued

Exemplary RT sequence (heterologous object sequence) and PBS sequence pairs Table 3D provides exemplified PBS sequences and heterologous object sequences (reverse transcription template regions) of a template RNA for correcting the pathogenic IVS10-11G > A mutation in PAH. The gRNA spacers from Table 1D were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1D, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 115 | gcagcagggaatactgatcctgatttaacagtgataataacttttcactTGGGGCCTACAG | 25981 | TACTGCTTatcagagaa | 26130 |
| 116 | gctccaggggggagaagctttggcttctctgataagcagtactgtaggcccCCAAGTGAAAAG | 25982 | TTATTATCactgttaaa | 26131 |
| 119 | gcagcagggaatactgatcctgatttaacagtgataataacttttcactTGGGGCCTACAGT | 25983 | ACTGCTTAtcagagaag | 26132 |
| 120 | gcagcagggaatactgatcctgatttaacagtgataataacttttcactTGGGGCCTACAGT | 25984 | ACTGCTTAtcagagaag | 26133 |
| 121 | gcagcagggaatactgatcctgatttaacagtgataataacttttcactTGGGGCCTACAGT | 25985 | ACTGCTTAtcagagaag | 26134 |
| 122 | gctccaggggggagaagctttggcttctctgataagcagtactgtaggcccCCAAGTGAAAAGT | 25986 | TATTATCActgttaaat | 26135 |
| 125 | gcagcagggaatactgatcctgatttaacagtgataataacttttcactTGGGGCCTACAGTA | 25987 | CTGCTTATcagagaagc | 26136 |
| 126 | gcagcagggaatactgatcctgatttaacagtgataataacttttcactTGGGGCCTACAGTA | 25988 | CTGCTTATcagagaagc | 26137 |
| 130 | gcagcagggaatactgatcctgatttaacagtgataataacttttcactTGGGGCCTACAGTA | 25989 | CTGCTTATcagagaagc | 26138 |
| 131 | gctccaggggggagaagctttggcttctctgataagcagtactgtaggcccCCAAGTGAAAAGTT | 25990 | ATTATCACtgttaaatc | 26139 |
| 132 | gctccaggggggagaagctttggcttctctgataagcagtactgtaggcccCCAAGTGAAAAGTT | 25991 | ATTATCACtgttaaatc | 26140 |
| 136 | gcagcagggaatactgatcctgatttaacagtgataataacttttcactTGGGGCCTACAGTAC | 25992 | TGCTTATCagagaagcc | 26141 |
| 137 | gcagcagggaatactgatcctgatttaacagtgataataacttttcactTGGGGCCTACAGTAC | 25993 | TGCTTATCagagaagcc | 26142 |
| 138 | gctccaggggggagaagctttggcttctctgataagcagtactgtaggcccCCAAGTGAAAAGTTA | 25994 | TTATCACTgttaaatca | 26143 |
| 139 | gcagcagggaatactgatcctgatttaacagtgataataacttttcactTGGGGCCTACAGTACT | 25995 | GCTTATCAgagaagcca | 26144 |
| 140 | gctccaggggggagaagctttggcttctctgataagcagtactgtaggcccCCAAGTGAAAAGTTAT | 25996 | TATCACTGttaaatcag | 26145 |
| 141 | gcagcagggaatactgatcctgatttaacagtgataataacttttcactTGGGGCCTACAGTACTG | 25997 | CTTATCAGagaagccaa | 26146 |
| 142 | gctccaggggggagaagctttggcttctctgataagcagtactgtaggcccCCAAGTGAAAAGTTATT | 25998 | ATCACTGTtaaatcagg | 26147 |
| 145 | gctccaggggggagaagctttggcttctctgataagcagtactgtaggcccCCAAGTGAAAAGTTATTA | 25999 | TCACTGTTaaatcagga | 26148 |
| 146 | gcagcagggaatactgatcctgatttaacagtgataataacttttcactTGGGGCCTACAGTACTGC | 26000 | TTATCAGAgaagccaaa | 26149 |

TABLE 3D-continued

Exemplary RT sequence (heterologous object sequence) and PBS sequence pairs Table 3D provides exemplified PBS sequences and heterologous object sequences (reverse transcription template regions) of a template RNA for correcting the pathogenic IVS10-11G > A mutation in PAH. The gRNA spacers from Table 1D were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1D, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 150 | gcagcagggaatactgatcctgatttaacagtgataataacttttcactTGGGGCCTACA GTACTGCT | 26001 | TATCAGAGa agccaaag | 26150 |
| 154 | gcagcagggaatactgatcctgatttaacagtgataataacttttcactTGGGGCCTACA GTACTGCT | 26002 | TATCAGAGa agccaaag | 26151 |
| 155 | gctccaggggggagaagctttggcttctctgataagcagtactgtaggccCCAAGTGAAA AGTTATTAT | 26003 | CACTGTTAaa tcaggat | 26152 |
| 156 | gcagcagggaatactgatcctgatttaacagtgataataacttttcactTGGGGCCTACA GTACTGCT | 26004 | TATCAGAGa agccaaag | 26153 |
| 157 | gctccaggggggagaagctttggcttctctgataagcagtactgtaggccCCAAGTGAAA AGTTATTAT | 26005 | CACTGTTAaa tcaggat | 26154 |
| 158 | gcagcagggaatactgatcctgatttaacagtgataataacttttcactTGGGGCCTACA GTACTGCT | 26006 | TATCAGAGa agccaaag | 26155 |
| 159 | gctccaggggggagaagctttggcttctctgataagcagtactgtaggccCCAAGTGAAA AGTTATTAT | 26007 | CACTGTTAaa tcaggat | 26156 |
| 164 | gctccaggggggagaagctttggcttctctgataagcagtactgtaggccCCAAGTGAAA AGTTATTATC | 26008 | ACTGTTAAat caggatc | 26157 |
| 167 | gcagcagggaatactgatcctgatttaacagtgataataacttttcactTGGGGCCTACA GTACTGCTT | 26009 | ATCAGAGAa gccaaagc | 26158 |
| 168 | gcagcagggaatactgatcctgatttaacagtgataataacttttcactTGGGGCCTACA GTACTGCTT | 26010 | ATCAGAGAa gccaaagc | 26159 |
| 169 | gctccaggggggagaagctttggcttctctgataagcagtactgtaggccCCAAGTGAAA AGTTATTATC | 26011 | ACTGTTAAat caggatc | 26160 |
| 173 | gcagcagggaatactgatcctgatttaacagtgataataacttttcactTGGGGCCTACA GTACTGCTTA | 26012 | TCAGAGAAg ccaaagct | 26161 |
| 174 | gctccaggggggagaagctttggcttctctgataagcagtactgtaggccCCAAGTGAAA AGTTATTATCA | 26013 | CTGTTAAAtc aggatca | 26162 |
| 175 | gcagcagggaatactgatcctgatttaacagtgataataacttttcactTGGGGCCTACA GTACTGCTTA | 26014 | TCAGAGAAg ccaaagct | 26163 |
| 179 | gcagcagggaatactgatcctgatttaacagtgataataacttttcactTGGGGCCTACA GTACTGCTTAT | 26015 | CAGAGAAGc caaagctt | 26164 |
| 180 | gcagcagggaatactgatcctgatttaacagtgataataacttttcactTGGGGCCTACA GTACTGCTTAT | 26016 | CAGAGAAGc caaagctt | 26165 |
| 183 | gcagcagggaatactgatcctgatttaacagtgataataacttttcactTGGGGCCTACA GTACTGCTTAT | 26017 | CAGAGAAGc caaagctt | 26166 |
| 187 | gcagcagggaatactgatcctgatttaacagtgataataacttttcactTGGGGCCTACA GTACTGCTTAT | 26018 | CAGAGAAGc caaagctt | 26167 |
| 188 | gctccaggggggagaagctttggcttctctgataagcagtactgtaggccCCAAGTGAAA AGTTATTATCAC | 26019 | TGTTAAATca ggatcag | 26168 |
| 191 | gctccaggggggagaagctttggcttctctgataagcagtactgtaggccCCAAGTGAAA AGTTATTATCACT | 26020 | GTTAAATCag gatcagt | 26169 |

TABLE 3D-continued

Exemplary RT sequence (heterologous object sequence) and PBS sequence pairs
Table 3D provides exemplified PBS sequences and heterologous object sequences (reverse transcription template regions) of a template RNA for correcting the pathogenic IVS10-11G > A mutation in PAH. The gRNA spacers from Table 1D were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1D, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 192 | gctccaggggggagaagctttggcttctctgataagcagtactgtaggcccCCAAGTGAAAAGTTATTATCACT | 26021 | GTTAAATCaggatcagt | 26170 |
| 195 | gcagcagggaatactgatcctgatttaacagtgataataacttttcactTGGGGCCTACAGTACTGCTTATC | 26022 | AGAGAAGCcaaagcttc | 26171 |
| 196 | gcagcagggaatactgatcctgatttaacagtgataataacttttcactTGGGGCCTACAGTACTGCTTATC | 26023 | AGAGAAGCcaaagcttc | 26172 |
| 197 | gctccaggggggagaagctttggcttctctgataagcagtactgtaggcccCCAAGTGAAAAGTTATTATCACT | 26024 | GTTAAATCaggatcagt | 26173 |
| 201 | gcagcagggaatactgatcctgatttaacagtgataataacttttcactTGGGGCCTACAGTACTGCTTATCA | 26025 | GAGAAGCCaaagcttct | 26174 |
| 204 | gctccaggggggagaagctttggcttctctgataagcagtactgtaggcccCCAAGTGAAAAGTTATTATCACTG | 26026 | TTAAATCAggatcagta | 26175 |
| 207 | gcagcagggaatactgatcctgatttaacagtgataataacttttcactTGGGGCCTACAGTACTGCTTATCA | 26027 | GAGAAGCCaaagcttct | 26176 |
| 209 | gctccaggggggagaagctttggcttctctgataagcagtactgtaggcccCCAAGTGAAAAGTTATTATCACTG | 26028 | TTAAATCAggatcagta | 26177 |
| 210 | gcagcagggaatactgatcctgatttaacagtgataataacttttcactTGGGGCCTACAGTACTGCTTATCA | 26029 | GAGAAGCCaaagcttct | 26178 |
| 211 | gcagcagggaatactgatcctgatttaacagtgataataacttttcactTGGGGCCTACAGTACTGCTTATCA | 26030 | GAGAAGCCaaagcttct | 26179 |
| 215 | gcagcagggaatactgatcctgatttaacagtgataataacttttcactTGGGGCCTACAGTACTGCTTATCAG | 26031 | AGAAGCCAaagcttctc | 26180 |
| 218 | gctccaggggggagaagctttggcttctctgataagcagtactgtaggcccCCAAGTGAAAAGTTATTATCACTGT | 26032 | TAAATCAGgatcagtat | 26181 |
| 219 | gctccaggggggagaagctttggcttctctgataagcagtactgtaggcccCCAAGTGAAAAGTTATTATCACTGT | 26033 | TAAATCAGgatcagtat | 26182 |
| 220 | gcagcagggaatactgatcctgatttaacagtgataataacttttcactTGGGGCCTACAGTACTGCTTATCAG | 26034 | AGAAGCCAaagcttctc | 26183 |
| 223 | gcagcagggaatactgatcctgatttaacagtgataataacttttcactTGGGGCCTACAGTACTGCTTATCAGA | 26035 | GAAGCCAAagcttctcc | 26184 |
| 224 | gctccaggggggagaagctttggcttctctgataagcagtactgtaggcccCCAAGTGAAAAGTTATTATCACTGTT | 26036 | AAATCAGGatcagtatt | 26185 |
| 225 | gctccaggggggagaagctttggcttctctgataagcagtactgtaggcccCCAAGTGAAAAGTTATTATCACTGTT | 26037 | AAATCAGGatcagtatt | 26186 |
| 226 | gctccaggggggagaagctttggcttctctgataagcagtactgtaggcccCCAAGTGAAAAGTTATTATCACTGTT | 26038 | AAATCAGGatcagtatt | 26187 |
| 229 | gcagcagggaatactgatcctgatttaacagtgataataacttttcactTGGGGCCTACAGTACTGCTTATCAGA | 26039 | GAAGCCAAagcttctcc | 26188 |

TABLE 3D-continued

Exemplary RT sequence (heterologous object sequence) and PBS sequence pairs
Table 3D provides exemplified PBS sequences and heterologous object sequences (reverse transcription template regions) of a template RNA for correcting the pathogenic IVS10-11G > A mutation in PAH. The gRNA spacers from Table 1D were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1D, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 232 | gctccaggggggagaagctttggcttctctgataagcagtactgtaggccCCAAGTGAAAAGTTATTATCACTGTT | 26040 | AAATCAGGatcagtatt | 26189 |
| 236 | gctccaggggggagaagctttggcttctctgataagcagtactgtaggccCCAAGTGAAAAGTTATTATCACTGTTA | 26041 | AATCAGGAtcagtattc | 26190 |
| 237 | gctccaggggggagaagctttggcttctctgataagcagtactgtaggccCCAAGTGAAAAGTTATTATCACTGTTA | 26042 | AATCAGGAtcagtattc | 26191 |
| 238 | gcagcagggaatactgatcctgatttaacagtgataataacttttcactTGGGGCCTACAGTACTGCTTATCAGAG | 26043 | AAGCCAAAgcttctccc | 26192 |
| 242 | gcagcagggaatactgatcctgatttaacagtgataataacttttcactTGGGGCCTACAGTACTGCTTATCAGAG | 26044 | AAGCCAAAgcttctccc | 26193 |
| 247 | gctccaggggggagaagctttggcttctctgataagcagtactgtaggccCCAAGTGAAAAGTTATTATCACTGTTAA | 26045 | ATCAGGATcagtattcc | 26194 |
| 250 | gcagcagggaatactgatcctgatttaacagtgataataacttttcactTGGGGCCTACAGTACTGCTTATCAGAGA | 26046 | AGCCAAAGCttctcccc | 26195 |
| 251 | gcagcagggaatactgatcctgatttaacagtgataataacttttcactTGGGGCCTACAGTACTGCTTATCAGAGA | 26047 | AGCCAAAGcttctcccc | 26196 |
| 252 | gctccaggggggagaagctttggcttctctgataagcagtactgtaggccCCAAGTGAAAAGTTATTATCACTGTTAA | 26048 | ATCAGGATcagtattcc | 26197 |
| 255 | gcagcagggaatactgatcctgatttaacagtgataataacttttcactTGGGGCCTACAGTACTGCTTATCAGAGAA | 26049 | GCCAAAGCttctccccc | 26198 |
| 256 | gctccaggggggagaagctttggcttctctgataagcagtactgtaggccCCAAGTGAAAAGTTATTATCACTGTTAAA | 26050 | TCAGGATCagtattccc | 26199 |
| 257 | gcagcagggaatactgatcctgatttaacagtgataataacttttcactTGGGGCCTACAGTACTGCTTATCAGAGAA | 26051 | GCCAAAGCttctccccc | 26200 |
| 258 | gctccaggggggagaagctttggcttctctgataagcagtactgtaggccCCAAGTGAAAAGTTATTATCACTGTTAAA | 26052 | TCAGGATCagtattccc | 26201 |
| 261 | gctccaggggggagaagctttggcttctctgataagcagtactgtaggccCCAAGTGAAAAGTTATTATCACTGTTAAA | 26053 | TCAGGATCagtattccc | 26202 |
| 262 | gcagcagggaatactgatcctgatttaacagtgataataacttttcactTGGGGCCTACAGTACTGCTTATCAGAGAA | 26054 | GCCAAAGCttctccccc | 26203 |
| 264 | gctccaggggggagaagctttggcttctctgataagcagtactgtaggccCCAAGTGAAAAGTTATTATCACTGTTAAAT | 26055 | CAGGATCAgtattccct | 26204 |
| 265 | gcagcagggaatactgatcctgatttaacagtgataataacttttcactTGGGGCCTACAGTACTGCTTATCAGAGAAG | 26056 | CCAAAGCTtctcccct | 26205 |
| 269 | gcagcagggaatactgatcctgatttaacagtgataataacttttcactTGGGGCCTACAGTACTGCTTATCAGAGAAGC | 26057 | CAAAGCTTctcccctg | 26206 |
| 270 | gctccaggggggagaagctttggcttctctgataagcagtactgtaggccCCAAGTGAAAAGTTATTATCACTGTTAAATC | 26058 | AGGATCAGtattccctg | 26207 |
| 271 | gctccaggggggagaagctttggcttctctgataagcagtactgtaggccCCAAGTGAAAAGTTATTATCACTGTTAAATC | 26059 | AGGATCAGtattccctg | 26208 |

TABLE 3D-continued

Exemplary RT sequence (heterologous object sequence) and PBS sequence pairs Table 3D provides exemplified PBS sequences and heterologous object sequences (reverse transcription template regions) of a template RNA for correcting the pathogenic IVS10-11G > A mutation in PAH. The gRNA spacers from Table 1D were filtered, e.g., filtered by occurrence within 15 nt of the desired editing location and use of a Tier 1 Cas enzyme. PBS sequences and heterologous object sequences (reverse transcription template regions) were designed relative to the nick site directed by the cognate gRNA from Table 1D, as described in this application. For exemplification, these regions were designed to be 8-17 nt (priming) and 1-50 nt extended beyond the location of the edit (RT). Without wishing to be limited by example, given variability of length, sequences are provided that use the maximum length parameters and comprise all templates of shorter length within the given parameters. Sequences are shown with uppercase letters indicating core sequence and lowercase letters indicating flanking sequence that may be truncated within the described length parameters.

| ID | RT Template Sequence | SEQ ID NO | PBS Sequence | SEQ ID NO |
|---|---|---|---|---|
| 272 | gctccaggggggagaagctttggcttctctgataagcagtactgtaggcccCCAAGTGAAAAGTTATTATCACTGTTAAATC | 26060 | AGGATCAGtattccctg | 26209 |
| 273 | gctccaggggggagaagctttggcttctctgataagcagtactgtaggcccCCAAGTGAAAAGTTATTATCACTGTTAAATCA | 26061 | GGATCAGTattccctgc | 26210 |
| 274 | gcagcagggaatactgatcctgatttaacagtgataataacttttcactTGGGGCCTACAGTACTGCTTATCAGAGAAGCC | 26062 | AAAGCTTCtccccctgg | 26211 |
| 275 | gctccaggggggagaagctttggcttctctgataagcagtactgtaggcccCCAAGTGAAAAGTTATTATCACTGTTAAATCA | 26063 | GGATCAGTattccctgc | 26212 |
| 276 | gcagcagggaatactgatcctgatttaacagtgataataacttttcactTGGGGCCTACAGTACTGCTTATCAGAGAAGCC | 26064 | AAAGCTTCtccccctgg | 26213 |
| 277 | gcagcagggaatactgatcctgatttaacagtgataataacttttcactTGGGGCCTACAGTACTGCTTATCAGAGAAGCC | 26065 | AAAGCTTCtccccctgg | 26214 |

Capital letters indicate "core nucleotides" while lower case letters indicate "flanking nucleotides." Herein, when an RNA sequence (e.g., a template RNA sequence) is said to comprise a particular sequence (e.g., a sequence of Table 3A, Table 3B, Table 3C, or Table 3D or a portion thereof) that comprises thymine (T), it is of course understood that the RNA sequence may (and frequently does) comprise uracil (U) in place of T. For instance, the RNA sequence may comprise U at every position shown as T in the sequence in Table 3A, Table 3B, Table 3C, or Table 3D. More specifically, the present disclosure provides an RNA sequence according to every heterologous object sequence and PBS sequence shown in Table 3A, Table 3B, Table 3C, or Table 3D, wherein the RNA sequence has a U in place of each T in the sequence of Table 3A, Table 3B, Table 3C, or Table 3D.

In some embodiments of the systems and methods herein, the template RNA comprises a gRNA scaffold (e.g., that binds a gene modifying polypeptide, e.g., a Cas polypeptide) that comprises a sequence of a gRNA scaffold of Table 12. In some embodiments, the gRNA scaffold comprises a sequence having at least 70%, 75%, 80%, 85%, 90%, 95%, 96%, 97%, 98%, or 99% identity to a gRNA scaffold of Table 12. In some embodiments, the gRNA scaffold comprises a sequence of a scaffold region of Table 12 that corresponds to the RT template sequence, the spacer sequence, or both, or a sequence having at least 70%, 75%, 80%, 85%, 90%, 95%, 96%, 97%, 98%, or 99% identity thereto.

In some embodiments of the systems and methods herein, the system further comprises a second strand-targeting gRNA that directs a nick to the second strand of the human PAH gene. In some embodiments, the second strand-targeting gRNA comprises a left gRNA spacer sequence or a right gRNA spacer sequence from Table 2A, Table 2B, Table 2C, or Table 2D. In some embodiments, the gRNA spacer additionally comprises one or more (e.g., 2, 3, or all) consecutive nucleotides starting with the 3' end of the flanking nucleotides of the left gRNA spacer sequence or right gRNA spacer sequence. In some embodiments, the second strand-targeting gRNA comprises a sequence comprising the core nucleotides of a second nick gRNA sequence from Table 4A, Table 4B, Table 4C, or Table 4D, or a sequence having at least 70%, 75%, 80%, 85%, 90%, 95%, 96%, 97%, 98%, or 99% identity thereto. In some embodiments, the second nick gRNA sequence additionally comprises one or more consecutive nucleotides starting with the 3' end of the flanking nucleotides of the second nick gRNA sequence. In some embodiments, the second nick gRNA comprises a gRNA scaffold sequence that is orthogonal to the Cas domain of the gene modifying polypeptide. In some embodiments, the second nick gRNA comprises a gRNA scaffold sequence of Table 12.

TABLE 2A

Exemplary left gRNA spacer and right gRNA spacer pairs
Table 2A provides exemplified second-nick gRNA species for optional use for correcting the pathogenic R408W mutation in PAH. The gRNA spacers from Table 1A were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 1 | CTCGTAAGGTGTAAATTACT | 26215 | TAC | AGTTCTCAGTGGCATTTTAC | 26595 | TTC |
| 2 | GGCTGATTCCATTAACAGTA | 26216 | AG | TTCCTAAAAAAGAAGTAAAA | 26596 | TG |
| 6 | CCATTAACAGTAAGTAATTT | 26217 | ACA | CCTAAAAAAGAAGTAAAATG | 26597 | CCA |
| 7 | TCGTAAGGTGTAAATTACTT | 26218 | ACT | GTTCTCAGTGGCATTTTACT | 26598 | TCT |
| 10 | tttTGGCTGATTCCATTAACAGTA | 26219 | AGTAATT | gaaGACCCTGCTCTAGGGAGGTGT | 26599 | CCGTGTT |
| 13 | CAGTAAGTAATTTACACCTT | 26220 | ACG | AAAAAAGAAGTAAAATGCCA | 26600 | CTG |
| 14 | TAAGTAATTTACACCTTACG | 26221 | AGG | TTGAAGACCCTGCTCTAGGG | 26601 | AGG |
| 17 | CATTAACAGTAAGTAATTTA | 26222 | CAC | CTAAAAAAGAAGTAAAATGC | 26602 | CAC |
| 18 | GTAAGGTGTAAATTACTTAC | 26223 | TG | TGGCATTTTACTTCTTTTTT | 26603 | AG |
| 21 | AGTAAGTAATTTACACCTTA | 26224 | CG | AAAAAGAAGTAAAATGCCAC | 26604 | TG |
| 25 | CGTAAGGTGTAAATTACTTA | 26225 | CTG | TTCTCAGTGGCATTTTACTT | 26605 | CTT |
| 26 | gtggCCTCGTAAGGTGTAAATTA | 26226 | CTTACTGT | aagaGAGTTCTCAGTGGCATTTT | 26606 | ACTTC |
| 29 | gtAAATTACTTACTGTTAATGGAA | 26227 | TCAGCC | ttTTACTTCTTTTTTAGGAACACG | 26607 | GACACC |
| 30 | AGTAAGTAATTTACACCTTAC | 26228 | GAGG | CTTAAGACTACCTTTCTCCAA | 26608 | ATGG |
| 31 | CAGTAAGTAATTTACACCTTA | 26229 | CGAG | AAAAAAGAAGTAAAATGCCAC | 26609 | TGAG |
| 34 | CGTAAGGTGTAAATTACTTA | 26230 | CTG | GTGGCATTTTACTTCTTTTT | 26610 | TAG |
| 35 | TGTAAATTACTTACTGTTAA | 26231 | TGG | TGGCATTTTACTTCTTTTTT | 26611 | AGG |
| 38 | GTAAGGTGTAAATTACTTAC | 26232 | TGT | TCTCAGTGGCATTTTACTTC | 26612 | TTT |
| 41 | CAGTAAGTAATTTACACCTT | 26233 | ACG | AAAAAAGAAGTAAAATGCCA | 26613 | CTG |
| 42 | ATTAACAGTAAGTAATTTAC | 26234 | ACC | TAAAAAAGAAGTAAAATGCC | 26614 | ACT |
| 43 | GTAAGGTGTAAATTACTTAC | 26235 | TG | TGGCATTTTACTTCTTTTTT | 26615 | AG |

TABLE 2A-continued

Exemplary left gRNA spacer and right gRNA spacer pairs
Table 2A provides exemplified second-nick gRNA species for optional use for correcting the pathogenic R408W mutation in PAH. The gRNA spacers from Table 1A were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 46 | gtggCCTCGTAAGGTGTAAATTA | 26236 | CTTACTGT | aagaGAGTTCTCAGTGGCATTTT | 26616 | ACTTC |
| 47 | gtggCCTCGTAAGGTGTAAATTA | 26237 | CTTACTGT | aagaGAGTTCTCAGTGGCATTTT | 26617 | ACTTC |
| 50 | gtAAATTACTTACTGTTAATGGAA | 26238 | TCAGCC | ttTTACTTCTTTTTAGGAACACG | 26618 | GACACC |
| 51 | AACAGTAAGTAATTTACACCT | 26239 | TACGA | TAAAAAAGAAGTAAAATGCCA | 26619 | CTGAG |
| 52 | AACAGTAAGTAATTTACACCT | 26240 | TACGA | TAAAAAAGAAGTAAAATGCCA | 26620 | CTGAG |
| 55 | GGTGTAAATTACTTACTGTTA | 26241 | ATGG | AGTGGCATTTTACTTCTTTTT | 26621 | TAGG |
| 56 | GGTGTAAATTACTTACTGTTA | 26242 | ATGG | CAGTGGCATTTTACTTCTTTT | 26622 | TTAG |
| 57 | CAGTAAGTAATTTACACCTTA | 26243 | CGAG | AAAAAAGAAGTAAAATGCCAC | 26623 | TGAG |
| 62 | CGTAAGGTGTAAATTACTTA | 26244 | CTG | GTGGCATTTTACTTCTTTTT | 26624 | TAG |
| 63 | TAAGGTGTAAATTACTTACT | 26245 | GTT | CTCAGTGGCATTTTACTTCT | 26625 | TTT |
| 64 | TTAACAGTAAGTAATTTACA | 26246 | CCT | AAAAAAGAAGTAAAATGCCA | 26626 | CTG |
| 65 | gtggCCTCGTAAGGTGTAAATTA | 26247 | CTTACTGT | agtgGCATTTTACTTCTTTTTTA | 26627 | GGAAC |
| 66 | AACAGTAAGTAATTTACACCT | 26248 | TACGA | AAAAAAGAAGTAAAATGCCAC | 26628 | TGAGA |
| 67 | GTAAGGTGTAAATTACTTACT | 26249 | GTTAAT | TCAGTGGCATTTTACTTCTTT | 26629 | TTTAG |
| 68 | TAACAGTAAGTAATTTACAC | 26250 | CTT | AAAAAGAAGTAAAATGCCAC | 26630 | TGA |
| 69 | AAGGTGTAAATTACTTACTG | 26251 | TTA | TCAGTGGCATTTTACTTCTT | 26631 | TTT |
| 72 | AACAGTAAGTAATTTACACCT | 26252 | TACGA | AAAAAGAAGTAAAATGCCACT | 26632 | GAGAA |
| 73 | AACAGTAAGTAATTTACACC | 26253 | TTA | AAAAGAAGTAAAATGCCACT | 26633 | GAG |
| 74 | AGGTGTAAATTACTTACTGT | 26254 | TAA | CAGTGGCATTTTACTTCTTT | 26634 | TTT |
| 77 | AGTAAGTAATTTACACCTTA | 26255 | CG | AAAGAAGTAAAATGCCACTG | 26635 | AG |
| 81 | ACAGTAAGTAATTTACACCT | 26256 | TAC | AAAGAAGTAAAATGCCACTG | 26636 | AGA |
| 82 | GGTGTAAATTACTTACTGTT | 26257 | AAT | AGTGGCATTTTACTTCTTTT | 26637 | TTA |

TABLE 2A-continued

Exemplary left gRNA spacer and right gRNA spacer pairs
Table 2A provides exemplified second-nick gRNA species for optional use for correcting the pathogenic R408W mutation in PAH. The gRNA spacers from Table 1A were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 86 | CAGTAAGTAATTTACACCTT | 26258 | ACG | AAAAGAAGTAAAATGCCACT | 26638 | GAG |
| 87 | TAAGTAATTTACACCTTACG | 26259 | AGG | TAAGACTACCTTTCTCCAAA | 26639 | TGG |
| 90 | CAGTAAGTAATTTACACCTT | 26260 | ACG | AAGAAGTAAAATGCCACTGA | 26640 | GAA |
| 91 | AGTAAGTAATTTACACCTTA | 26261 | CG | AAAGAAGTAAAATGCCACTG | 26641 | AG |
| 94 | GTGTAAATTACTTACTGTTA | 26262 | ATG | GTGGCATTTTACTTCTTTTT | 26642 | TAG |
| 95 | acagTAAGTAATTTACACCTTAC | 26263 | GAGGC | aaaaAAGAAGTAAAATGCCACTG | 26643 | AGAAC |
| 96 | acagTAAGTAATTTACACCTTAC | 26264 | GAGGC | aaaaAAGAAGTAAAATGCCACTG | 26644 | AGAAC |
| 99 | aaCAGTAAGTAATTTACACCTTAC | 26265 | GAGGCC | tcCGTGTTCCTAAAAAAGAAGTAA | 26645 | AATGCC |
| 100 | AGTAAGTAATTTACACCTTAC | 26266 | GAGG | CTTAAGACTACCTTTCTCCAA | 26646 | ATGG |
| 101 | CAGTAAGTAATTTACACCTTA | 26267 | CGAG | AAAAAAGAAGTAAAATGCCAC | 26647 | TGAG |
| 104 | GTAAGTAATTTACACCTTAC | 26268 | GAG | AAAAGAAGTAAAATGCCACT | 26648 | GAG |
| 105 | TAAGTAATTTACACCTTACG | 26269 | AGG | TAAGACTACCTTTCTCCAAA | 26649 | TGG |
| 108 | AGTAAGTAATTTACACCTTA | 26270 | CGA | AGAAGTAAAATGCCACTGAG | 26650 | AAC |
| 109 | AGTAAGTAATTTACACCTTA | 26271 | CG | AAAGAAGTAAAATGCCACTG | 26651 | AG |
| 112 | TGTAAATTACTTACTGTTAA | 26272 | TGG | TGGCATTTTACTTCTTTTTT | 26652 | AGG |
| 113 | acagTAAGTAATTTACACCTTAC | 26273 | GAGGC | aaaaGAAGTAAAATGCCACTGAG | 26653 | AACTC |
| 114 | acagTAAGTAATTTACACCTTAC | 26274 | GAGGC | aaaaGAAGTAAAATGCCACTGAG | 26654 | AACTC |
| 115 | gtgtAAATTACTTACTGTTAATG | 26275 | GAATC | agtgGCATTTTACTTCTTTTTTA | 26655 | GGAAC |
| 116 | acagTAAGTAATTTACACCTTAC | 26276 | GAGGC | aaaaGAAGTAAAATGCCACTGAG | 26656 | AACTC |
| 117 | gtgtAAATTACTTACTGTTAATG | 26277 | GAATC | agtgGCATTTTACTTCTTTTTTA | 26657 | GGAAC |
| 119 | gtAAATTACTTACTGTTAATGGAA | 26278 | TCAGCC | ttTTACTTCTTTTTTAGGAACACG | 26658 | GACACC |
| 120 | taACAGTAAGTAATTTACACCTT | 26279 | ACGAG | taAAAAAGAAGTAAAATGCCACT | 26659 | GAGAA |

TABLE 2A-continued

Exemplary left gRNA spacer and right gRNA spacer pairs
Table 2A provides exemplified second-nick gRNA species for optional use for correcting the pathogenic R408W mutation in PAH. The gRNA spacers from Table 1A were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 121 | CAGTAAGTAATTTACACCTTA | 26280 | CGAGG | AAAAAGAAGTAAAATGCCACT | 26660 | GAGAA |
| 122 | AGTAAGTAATTTACACCTTAC | 26281 | GAGG | CTTAAGACTACCTTTCTCCAA | 26661 | ATGG |
| 123 | AGTAAGTAATTTACACCTTAC | 26282 | GAGG | AAAAAAGAAGTAAAATGCCAC | 26662 | TGAG |
| 126 | GTAAGTAATTTACACCTTAC | 26283 | GAG | AAAAGAAGTAAAATGCCACT | 26663 | GAG |
| 127 | GTAAGTAATTTACACCTTAC | 26284 | GAG | GAAGTAAAATGCCACTGAGA | 26664 | ACT |
| 128 | GTAAATTACTTACTGTTAAT | 26285 | GGA | GGCATTTTACTTCTTTTTTA | 26665 | GGA |
| 129 | gtgtAAATTACTTACTGTTAATG | 26286 | GAATC | agtgGCATTTTACTTCTTTTTTA | 26666 | GGAAC |
| 130 | gtgtAAATTACTTACTGTTAATG | 26287 | GAATC | agtgGCATTTTACTTCTTTTTTA | 26667 | GGAAC |
| 134 | CAGTAAGTAATTTACACCTTA | 26288 | CGAGG | TAAAATGCCACTGAGAACTCT | 26668 | CTTAA |
| 135 | AGTAAGTAATTTACACCTTAC | 26289 | GAGG | AAATGCCACTGAGAACTCTCT | 26669 | TAAG |
| 138 | TAAGTAATTTACACCTTACG | 26290 | AGG | AAGTAAAATGCCACTGAGAA | 26670 | CTC |
| 140 | TAAATTACTTACTGTTAATG | 26291 | GAA | GCATTTTACTTCTTTTTTAG | 26671 | GAA |
| 146 | CAGTAAGTAATTTACACCTTA | 26292 | CGAGG | TAAAATGCCACTGAGAACTCT | 26672 | CTTAA |
| 147 | AAGTAATTTACACCTTACGA | 26293 | GG | AAAGAAGTAAAATGCCACTG | 26673 | AG |
| 151 | AAGTAATTTACACCTTACGA | 26294 | GGC | AGTAAAATGCCACTGAGAAC | 26674 | TCT |
| 152 | AAATTACTTACTGTTAATGG | 26295 | AAT | CATTTTACTTCTTTTTTAGG | 26675 | AAC |
| 158 | taACAGTAAGTAATTTACACCTT | 26296 | ACGAG | taAAAAAGAAGTAAAATGCCACT | 26676 | GAGAA |
| 159 | CAGTAAGTAATTTACACCTTA | 26297 | CGAGG | TAAAATGCCACTGAGAACTCT | 26677 | CTTAA |
| 160 | AAATTACTTACTGTTAATGGA | 26298 | ATCAG | ATTTTACTTCTTTTTTAGGAA | 26678 | CACGG |
| 161 | AAATTACTTACTGTTAATGGA | 26299 | ATCAG | ATTTTACTTCTTTTTTAGGAA | 26679 | CACGG |
| 166 | TAAGTAATTTACACCTTACG | 26300 | AGG | ATGCCACTGAGAACTCTCTT | 26680 | AAG |
| 167 | AGTAATTTACACCTTACGAG | 26301 | GCC | GTAAAATGCCACTGAGAACT | 26681 | CTC |

TABLE 2A-continued

Exemplary left gRNA spacer and right gRNA spacer pairs
Table 2A provides exemplified second-nick gRNA species for optional use for correcting the pathogenic R408W mutation in PAH. The gRNA spacers from Table 1A were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 168 | AATTACTTACTGTTAATGGA | 26302 | ATC | ATTTTACTTCTTTTTTAGGA | 26682 | ACA |
| 174 | AATTTACACCTTACGAGGCCA | 26303 | CTCGG | TAAAATGCCACTGAGAACTCT | 26683 | CTTAA |
| 175 | ATTTACACCTTACGAGGCCAC | 26304 | TCGG | AAATGCCACTGAGAACTCTCT | 26684 | TAAG |
| 177 | AAGTAATTTACACCTTACGA | 26305 | GG | TGCCACTGAGAACTCTCTTA | 26685 | AG |
| 181 | GTAATTTACACCTTACGAGG | 26306 | CCA | TAAAATGCCACTGAGAACTC | 26686 | TCT |
| 182 | ATTACTTACTGTTAATGGAA | 26307 | TCA | TTTTACTTCTTTTTTAGGAA | 26687 | CAC |
| 187 | taACAGTAAGTAATTTACACCTT | 26308 | ACGAG | taAAAAAGAAGTAAAATGCCACT | 26688 | GAGAA |
| 188 | AATTTACACCTTACGAGGCCA | 26309 | CTCGG | TAAAATGCCACTGAGAACTCT | 26689 | CTTAA |
| 191 | TTTACACCTTACGAGGCCAC | 26310 | TCG | ATGCCACTGAGAACTCTCTT | 26690 | AAG |
| 192 | TAATTTACACCTTACGAGGC | 26311 | CAC | AAAATGCCACTGAGAACTCT | 26691 | CTT |
| 193 | TTACTTACTGTTAATGGAAT | 26312 | CAG | TTTACTTCTTTTTTAGGAAC | 26692 | ACG |
| 194 | aaatTACTTACTGTTAATGGAAT | 26313 | CAGCC | atttTACTTCTTTTTTAGGAACA | 26693 | CGGAC |
| 195 | aaatTACTTACTGTTAATGGAAT | 26314 | CAGCC | atttTACTTCTTTTTTAGGAACA | 26694 | CGGAC |
| 198 | AATTTACACCTTACGAGGCCA | 26315 | CTCGG | AAAATGCCACTGAGAACTCTC | 26695 | TTAAG |
| 199 | TACTTACTGTTAATGGAATC | 26316 | AG | TTACTTCTTTTTTAGGAACA | 26696 | CG |
| 203 | TACTTACTGTTAATGGAATC | 26317 | AGC | TTACTTCTTTTTTAGGAACA | 26697 | CGG |
| 204 | AATTTACACCTTACGAGGCC | 26318 | ACT | AAATGCCACTGAGAACTCTC | 26698 | TTA |
| 208 | TTACTTACTGTTAATGGAAT | 26319 | CAG | TTACTTCTTTTTTAGGAACA | 26699 | CGG |
| 209 | ACTTACTGTTAATGGAATCA | 26320 | GCC | TACTTCTTTTTTAGGAACAC | 26700 | GGA |
| 210 | ATTTACACCTTACGAGGCCA | 26321 | CTC | AATGCCACTGAGAACTCTCT | 26701 | TAA |
| 211 | aaatTACTTACTGTTAATGGAAT | 26322 | CAGCC | atttTACTTCTTTTTTAGGAACA | 26702 | CGGAC |
| 214 | gtAAATTACTTACTGTTAATGGAA | 26323 | TCAGCC | ttTTACTTCTTTTTTAGGAACACG | 26703 | GACACC |

TABLE 2A-continued

Exemplary left gRNA spacer and right gRNA spacer pairs
Table 2A provides exemplified second-nick gRNA species for optional use for correcting the pathogenic R408W mutation in PAH. The gRNA spacers from Table 1A were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 215 | TTTACACCTTACGAGGCCAC | 26324 | TCG | ATGCCACTGAGAACTCTCTT | 26704 | AAG |
| 217 | CTTACTGTTAATGGAATCAG | 26325 | CCA | ACTTCTTTTTTAGGAACACG | 26705 | GAC |
| 218 | cttaCTGTTAATGGAATCAGCCA | 26326 | AAATCTTA | tttaCTTCTTTTTTAGGAACACG | 26706 | GACAC |
| 221 | TTACACCTTACGAGGCCACT | 26327 | CG | TGCCACTGAGAACTCTCTTA | 26707 | AG |
| 224 | TACTTACTGTTAATGGAATC | 26328 | AG | TACTTCTTTTTTAGGAACAC | 26708 | GG |
| 228 | TTACACCTTACGAGGCCACT | 26329 | CGG | TGCCACTGAGAACTCTCTTA | 26709 | AGA |
| 230 | TTACTGTTAATGGAATCAGC | 26330 | CAA | CTTCTTTTTTAGGAACACGG | 26710 | ACA |
| 231 | tttaCACCTTACGAGGCCACTCG | 26331 | GTTTC | aaaaTGCCACTGAGAACTCTCTT | 26711 | AAGAC |
| 232 | tttaCACCTTACGAGGCCACTCG | 26332 | GTTTC | aaaaTGCCACTGAGAACTCTCTT | 26712 | AAGAC |
| 238 | taACAGTAAGTAATTTACACCTT | 26333 | ACGAG | taAAAAAGAAGTAAAATGCCACT | 26713 | GAGAA |
| 239 | AATTTACACCTTACGAGGCCA | 26334 | CTCGGT | AAATGCCACTGAGAACTCTCT | 26714 | TAAGA |
| 242 | TTACACCTTACGAGGCCACT | 26335 | CGG | ATGCCACTGAGAACTCTCTT | 26715 | AAG |
| 243 | TACACCTTACGAGGCCACTC | 26336 | GGT | GCCACTGAGAACTCTCTTAA | 26716 | GAC |
| 246 | TTACTTACTGTTAATGGAAT | 26337 | CAG | TTACTTCTTTTTTAGGAACA | 26717 | CGG |
| 247 | TACTGTTAATGGAATCAGCC | 26338 | AAA | TTCTTTTTTAGGAACACGGA | 26718 | CAC |
| 251 | AATTTACACCTTACGAGGCCA | 26339 | CTCGGT | AAATGCCACTGAGAACTCTCT | 26719 | TAAGA |
| 252 | TACACCTTACGAGGCCACTC | 26340 | GG | TGCCACTGAGAACTCTCTTA | 26720 | AG |
| 256 | ACACCTTACGAGGCCACTCG | 26341 | GTT | CCACTGAGAACTCTCTTAAG | 26721 | ACT |
| 257 | ACTGTTAATGGAATCAGCCA | 26342 | AAA | TCTTTTTTAGGAACACGGAC | 26722 | ACC |
| 258 | cttaCTGTTAATGGAATCAGCCA | 26343 | AAATC | acttCTTTTTTAGGAACACGGAC | 26723 | ACCTC |
| 264 | TTACACCTTACGAGGCCACT | 26344 | CGG | ATGCCACTGAGAACTCTCTT | 26724 | AAG |
| 265 | CACCTTACGAGGCCACTCGG | 26345 | TTT | CACTGAGAACTCTCTTAAGA | 26725 | CTA |

TABLE 2A-continued

Exemplary left gRNA spacer and right gRNA spacer pairs
Table 2A provides exemplified second-nick gRNA species for optional use for correcting the pathogenic R408W mutation in PAH. The gRNA spacers from Table 1A were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 266 | CTGTTAATGGAATCAGCCAA | 26364 | AAT | CTTTTTTAGGAACACGGACA | 26726 | CCT |
| 268 | CTTACGAGGCCACTCGGTTTC | 26347 | TCAG | AAATGCCACTGAGAACTCTCT | 26727 | TAAG |
| 269 | ACCTTACGAGGCCACTCGGT | 26348 | TTC | ACTGAGAACTCTCTTAAGAC | 26728 | TAC |
| 270 | TGTTAATGGAATCAGCCAAA | 26349 | ATC | TTTTTTAGGAACACGGACAC | 26729 | CTC |
| 271 | tacaCCTTACGAGGCCACTCGGT | 26350 | TTCTCAGT | tgccACTGAGAACTCTCTTAAGA | 26730 | CTACCTTT |
| 272 | tacaCCTTACGAGGCCACTCGGT | 26351 | TTCTCAGT | tgccACTGAGAACTCTCTTAAGA | 26731 | CTACCTTT |
| 274 | tacaCCTTACGAGGCCACTCGGT | 26352 | TTCTCAGT | tgccACTGAGAACTCTCTTAAGA | 26732 | CTACCTTT |
| 275 | CCTTACGAGGCCACTCGGTTT | 26353 | CTCAG | ACTCTCTTAAGACTACCTTTC | 26733 | TCCAA |
| 276 | ACGAGGCCACTCGGTTTCTC | 26354 | AG | TGCCACTGAGAACTCTCTTA | 26734 | AG |
| 280 | CCTTACGAGGCCACTCGGTT | 26355 | TCT | CTGAGAACTCTCTTAAGACT | 26735 | ACC |
| 281 | GTTAATGGAATCAGCCAAAA | 26356 | TCT | TTTTTAGGAACACGGACACC | 26736 | TCC |
| 286 | TACGAGGCCACTCGGTTTCT | 26357 | CAG | ATGCCACTGAGAACTCTCTT | 26737 | AAG |
| 287 | CTTACGAGGCCACTCGGTTT | 26358 | CTC | TGAGAACTCTCTTAAGACTA | 26738 | CCT |
| 288 | TTAATGGAATCAGCCAAAAT | 26359 | CTT | TTTTAGGAACACGGACACCT | 26739 | CCC |
| 293 | TGGAATCAGCCAAAATCTTA | 26360 | AG | AGGAACACGGACACCTCCCT | 26740 | AG |
| 297 | TAATGGAATCAGCCAAAATC | 26361 | TTA | TTTAGGAACACGGACACCTC | 26741 | CCT |
| 298 | TTACGAGGCCACTCGGTTTC | 26362 | TCA | GAGAACTCTCTTAAGACTAC | 26742 | CTT |
| 299 | gttaATGGAATCAGCCAAAATCT | 26363 | TAAGC | ttctTTTTTAGGAACACGGACAC | 26743 | CTCCCTAG |
| 300 | gttaATGGAATCAGCCAAAATCT | 26364 | TAAGC | ttctTTTTTAGGAACACGGACAC | 26744 | CTCCCTAG |
| 306 | gaATCAGCCAAAATCTTAAGCTG | 26365 | CTGGG | ttTTAGGAACACGGACACCTCCC | 26745 | TAGAG |
| 307 | TTAATGGAATCAGCCAAAATC | 26366 | TTAAG | TTTAGGAACACGGACACCTCC | 26746 | CTAGA |
| 310 | ATGGAATCAGCCAAAATCTT | 26367 | AAG | TAGGAACACGGACACCTCCC | 26747 | TAG |

TABLE 2A-continued

Exemplary left gRNA spacer and right gRNA spacer pairs
Table 2A provides exemplified second-nick gRNA species for optional use for correcting the pathogenic R408W mutation in PAH. The gRNA spacers from Table 1A were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 311 | CAGCCAAAATCTTAAGCTGC | 26368 | TGG | CACGGACACCTCCCTAGAGC | 26748 | AGG |
| 314 | AATGGAATCAGCCAAAATCT | 26369 | TAA | TTAGGAACACGGACACCTCC | 26749 | CTA |
| 315 | ACGAGGCCACTCGGTTTCTC | 26370 | AG | TGCCACTGAGAACTCTCTTA | 26750 | AG |
| 318 | TGGAATCAGCCAAAATCTTA | 26371 | AG | AGGAACACGGACACCTCCCT | 26751 | AG |
| 322 | TACGAGGCCACTCGGTTTCT | 26372 | CAG | AGAACTCTCTTAAGACTACC | 26752 | TTT |
| 328 | gaATCAGCCAAAATCTTAAGCTG | 26373 | CTGGG | ttTTAGGAACACGGACACCTCCC | 26753 | TAGAG |
| 329 | TTAATGGAATCAGCCAAAATC | 26374 | TTAAG | TTAGGAACACGGACACCTCCC | 26754 | TAGAG |
| 330 | ATCAGCCAAAATCTTAAGCTG | 26375 | CTGG | AACACGGACACCTCCCTAGAG | 26755 | CAGG |
| 331 | TAATGGAATCAGCCAAAATCT | 26376 | TAAG | TAGGAACACGGACACCTCCCT | 26756 | AGAG |
| 334 | TACGAGGCCACTCGGTTTCT | 26377 | CAG | TTAAGACTACCTTTCTCCAA | 26757 | ATG |
| 335 | TTACACCTTACGAGGCCACT | 26378 | CGG | TAAGACTACCTTTCTCCAAA | 26758 | TGG |
| 338 | ACGAGGCCACTCGGTTTCTC | 26379 | AGT | GAACTCTCTTAAGACTACCT | 26759 | TTC |
| 341 | ATGGAATCAGCCAAAATCTT | 26380 | AAG | TAGGAACACGGACACCTCCC | 26760 | TAG |
| 342 | ATGGAATCAGCCAAAATCTT | 26381 | AAG | TAGGAACACGGACACCTCCC | 26761 | TAG |
| 343 | ACGAGGCCACTCGGTTTCTC | 26382 | AG | TGCCACTGAGAACTCTCTTA | 26762 | AG |
| 346 | tacgAGGCCACTCGGTTTCTCAG | 26383 | TAATCGAA | tgagAACTCTCTTAAGACTACCT | 26763 | TTCTC |
| 347 | tacgAGGCCACTCGGTTTCTCAG | 26384 | TAATCGAA | tgagAACTCTCTTAAGACTACCT | 26764 | TTCTC |
| 351 | TTAATGGAATCAGCCAAAATC | 26385 | TTAAG | TTAGGAACACGGACACCTCCC | 26765 | TAGAG |
| 352 | ATTTACACCTTACGAGGCCAC | 26386 | TCGG | CTTAAGACTACCTTTCTCCAA | 26766 | ATGG |
| 353 | CTTACGAGGCCACTCGGTTTC | 26387 | TCAG | CTTAAGACTACCTTTCTCCAA | 26767 | ATGG |
| 354 | TAATGGAATCAGCCAAAATCT | 26388 | TAAG | TAGGAACACGGACACCTCCCT | 26768 | AGAG |
| 357 | TACGAGGCCACTCGGTTTCT | 26389 | CAG | TTAAGACTACCTTTCTCCAA | 26769 | ATG |

TABLE 2A-continued

Exemplary left gRNA spacer and right gRNA spacer pairs
Table 2A provides exemplified second-nick gRNA species for optional use for correcting the pathogenic R408W mutation in PAH. The gRNA spacers from Table 1A were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 358 | TTACACCTTACGAGGCCACT | 26390 | CGG | TAAGACTACCTTTCTCCAAA | 26770 | TGG |
| 361 | CGAGGCCACTCGGTTTCTCA | 26391 | GTA | AACTCTCTTAAGACTACCTT | 26771 | TCT |
| 362 | ACGAGGCCACTCGGTTTCTC | 26392 | AG | TAAGACTACCTTTCTCCAAA | 26772 | TG |
| 365 | TGGAATCAGCCAAAATCTTA | 26393 | AGC | AGGAACACGGACACCTCCCT | 26773 | AGA |
| 366 | GTGTAAATTACTTACTGTTA | 26394 | ATGGAAT | AGTGGCATTTTACTTCTTTT | 26774 | TTAGGAA |
| 369 | gaGGCCACTCGGTTTCTCAGTAA | 26395 | TCGAA | taAAAAAGAAGTAAAATGCCACT | 26775 | GAGAA |
| 370 | TACGAGGCCACTCGGTTTCTC | 26396 | AGTAAT | ACTCTCTTAAGACTACCTTTC | 26776 | TCCAA |
| 371 | gaGGCCACTCGGTTTCTCAGTAA | 26397 | TCGAA | taAAAAAGAAGTAAAATGCCACT | 26777 | GAGAA |
| 372 | TACGAGGCCACTCGGTTTCTC | 26398 | AGTAAT | ACTCTCTTAAGACTACCTTTC | 26778 | TCCAA |
| 375 | AATCAGCCAAAATCTTAAGCT | 26399 | GCTGG | GGAACACGGACACCTCCCTAG | 26779 | AGCAG |
| 376 | ATTTACACCTTACGAGGCCAC | 26400 | TCGG | CTTAAGACTACCTTTCTCCAA | 26780 | ATGG |
| 377 | CTTACGAGGCCACTCGGTTTC | 26401 | TCAG | CTTAAGACTACCTTTCTCCAA | 26781 | ATGG |
| 380 | TACGAGGCCACTCGGTTTCT | 26402 | CAG | TTAAGACTACCTTTCTCCAA | 26782 | ATG |
| 381 | GAGGCCACTCGGTTTCTCAG | 26403 | TAA | ACTCTCTTAAGACTACCTTT | 26783 | CTC |
| 382 | GGAATCAGCCAAAATCTTAA | 26404 | GCT | GGAACACGGACACCTCCCTA | 26784 | GAG |

TABLE 2B

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 1 | gcAGCAGGAAAAGATGGCGCTCAT | 26975 | TGTGCC | aaGAAGAAAGAAAACTCAAAGCTC | 27329 | ATCACC |

TABLE 2B-continued

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 2 | AGGAAAAGATGGCGCTCATT | 26976 | GTG | AAAAGAAGAAAGAAAACTCA | 27330 | AAG |
| 3 | agcaGGAAAAGATGGCGCTCATT | 26977 | GTGCCTGG | gatgAAAAGAAGAAAGAAAACTC | 27331 | AAAGC |
| 4 | AGCTACCAGTTGCCAGGCACA | 26978 | ATGAG | CTGACTCAGTGGTGATGAGCT | 27332 | TTGAGT |
| 5 | GCTACCAGTTGCCAGGCACAA | 26979 | TGAG | TGACTCAGTGGTGATGAGCTT | 27333 | TGAG |
| 8 | GTTGCCAGGCACAATGAGCG | 26980 | CCA | GGTGATGAGCTTTGAGTTTT | 27334 | CTT |
| 10 | GGAAAAGATGGCGCTCATTG | 26981 | TGC | AAAGAAGAAAGAAAACTCAA | 27335 | AGC |
| 13 | AGCTACCAGTTGCCAGGCACA | 26982 | ATGAG | CTGACTCAGTGGTGATGAGCT | 27336 | TTGAGT |
| 14 | GGAAAAGATGGCGCTCATTG | 26983 | TG | AAAGAAGAAAGAAAACTCAA | 27337 | AG |
| 17 | CAGTTGCCAGGCACAATGAG | 26984 | CG | CTCAGTGGTGATGAGCTTTG | 27338 | AG |
| 21 | GAAAAGATGGCGCTCATTGT | 26985 | GCC | AAGAAGAAAGAAAACTCAAA | 27339 | GCT |
| 23 | TTGCCAGGCACAATGAGCGC | 26986 | CAT | GTGATGAGCTTTGAGTTTTC | 27340 | TTT |
| 29 | ccAGCTACCAGTTGCCAGGCACA | 26987 | ATGAG | ctCTGACTCAGTGGTGATGAGCT | 27341 | TTGAG |
| 30 | AGCTACCAGTTGCCAGGCACA | 26988 | ATGAG | CTGACTCAGTGGTGATGAGCT | 27342 | TTGAGT |
| 33 | AAAGATGGCGCTCATTGTGC | 26989 | CTG | AAAAGAAGAAAGAAAACTCA | 27343 | AAG |
| 34 | AAAAGATGGCGCTCATTGTG | 26990 | CCT | AGAAGAAAGAAAACTCAAAG | 27344 | CTC |
| 37 | CCAGTTGCCAGGCACAATGA | 26991 | GCG | ACTCAGTGGTGATGAGCTTT | 27345 | GAG |
| 38 | TCCTCCAGCTACCAGTTGCC | 26992 | AGG | TCCTAGTGCCTCTGACTCAG | 27346 | TGG |
| 41 | TGCCAGGCACAATGAGCGCC | 26993 | ATC | TGATGAGCTTTGAGTTTTCT | 27347 | TTC |
| 42 | CAGTTGCCAGGCACAATGAG | 26994 | CG | CTCAGTGGTGATGAGCTTTG | 27348 | AG |
| 45 | ggaaAAGATGGCGCTCATTGTGC | 26995 | CTGGC | aaagAAGAAAGAAAACTCAAAGC | 27349 | TCATC |
| 51 | ccAGCTACCAGTTGCCAGGCACA | 26996 | ATGAG | ctCTGACTCAGTGGTGATGAGCT | 27350 | TTGAG |
| 52 | AGCTACCAGTTGCCAGGCACA | 26997 | ATGAG | AGTTTTCTTTCTTCTTTTCAT | 27351 | CCCAG |

TABLE 2B-continued

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 53 | TGTCCTCCAGCTACCAGTTGC | 26998 | CAGG | TTCTTTTCATCCCAGCTTGCA | 27352 | CTGG |
| 54 | GCTACCAGTTGCCAGGCACAA | 26999 | TGAG | TGACTCAGTGGTGATGAGCTT | 27353 | TGAG |
| 55 | AAAAGATGGCGCTCATTGTGC | 27000 | CTGG | TGAAAAGAAGAAAGAAAACTC | 27354 | AAAG |
| 60 | CCAGTTGCCAGGCACAATGA | 27001 | GCG | ACTCAGTGGTGATGAGCTTT | 27355 | GAG |
| 61 | GCCAGGCACAATGAGCGCCA | 27002 | TCT | GATGAGCTTTGAGTTTTCTT | 27356 | TCT |
| 62 | AAAGATGGCGCTCATTGTGC | 27003 | CTG | GAAGAAAGAAAACTCAAAGC | 27357 | TCA |
| 65 | AAGATGGCGCTCATTGTGCCT | 27004 | GGCAA | GAAAACTCAAAGCTCATCACC | 27358 | ACTGA |
| 66 | ATGAGCGCCATCTTTTCCTGC | 27005 | TGCAA | AGTTTTCTTTCTTCTTTTCAT | 27359 | CCCAG |
| 67 | AAGATGGCGCTCATTGTGCCT | 27006 | GGCAA | GAAAACTCAAAGCTCATCACC | 27360 | ACTGA |
| 70 | CCAGGCACAATGAGCGCCAT | 27007 | CTT | ATGAGCTTTGAGTTTTCTTT | 27361 | CTT |
| 71 | AAGATGGCGCTCATTGTGCC | 27008 | TGG | AAGAAAGAAAACTCAAAGCT | 27362 | CAT |
| 73 | AAGATGGCGCTCATTGTGCCT | 27009 | GGCAA | GAAAACTCAAAGCTCATCACC | 27363 | ACTGA |
| 74 | CAGGCACAATGAGCGCCATC | 27010 | TTT | TGAGCTTTGAGTTTTCTTTC | 27364 | TTC |
| 75 | AGATGGCGCTCATTGTGCCT | 27011 | GGC | AGAAAGAAAACTCAAAGCTC | 27365 | ATC |
| 78 | AGGCACAATGAGCGCCATCT | 27012 | TTT | GAGCTTTGAGTTTTCTTTCT | 27366 | TCT |
| 79 | GATGGCGCTCATTGTGCCTG | 27013 | GCA | GAAAGAAAACTCAAAGCTCA | 27367 | TCA |
| 81 | CAATGAGCGCCATCTTTTCC | 27014 | TG | TTCTTTCTTCTTTTCATCCC | 27368 | AG |
| 85 | GGCACAATGAGCGCCATCTT | 27015 | TTC | AGCTTTGAGTTTTCTTTCTT | 27369 | CTT |
| 86 | ATGGCGCTCATTGTGCCTGG | 27016 | CAA | AAAGAAAACTCAAAGCTCAT | 27370 | CAC |
| 87 | aaagATGGCGCTCATTGTGCCTG | 27017 | GCAACTGG | gaagAAAGAAAACTCAAAGCTCA | 27371 | TCACC |
| 88 | aaagATGGCGCTCATTGTGCCTG | 27018 | GCAACTGG | gaagAAAGAAAACTCAAAGCTCA | 27372 | TCACC |
| 91 | gcAGCAGGAAAAGATGGCGCTCAT | 27019 | TGTGCC | aaGAAGAAAGAAAACTCAAAGCTC | 27373 | ATCACC |

TABLE 2B-continued

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 94 | ACAATGAGCGCCATCTTTTC | 27020 | CTG | TTTCTTTCTTCTTTTCATCC | 27374 | CAG |
| 95 | GCACAATGAGCGCCATCTTT | 27021 | TCC | GCTTTGAGTTTTCTTTCTTC | 27375 | TTT |
| 96 | TGGCGCTCATTGTGCCTGGC | 27022 | AAC | AAGAAAACTCAAAGCTCATC | 27376 | ACC |
| 97 | aggcACAATGAGCGCCATCTTTT | 27023 | CCTGC | tgagCTTTGAGTTTTCTTTCTTC | 27377 | TTTTC |
| 98 | aaagATGGCGCTCATTGTGCCTG | 27024 | GCAACTGG | agaaAGAAAACTCAAAGCTCATC | 27378 | ACCAC |
| 99 | aaagATGGCGCTCATTGTGCCTG | 27025 | GCAACTGG | agaaAGAAAACTCAAAGCTCATC | 27379 | ACCAC |
| 100 | aggcACAATGAGCGCCATCTTTT | 27026 | CCTGC | tgagCTTTGAGTTTTCTTTCTTC | 27380 | TTTTC |
| 101 | aaagATGGCGCTCATTGTGCCTG | 27027 | GCAACTGG | agaaAGAAAACTCAAAGCTCATC | 27381 | ACCAC |
| 106 | ATGAGCGCCATCTTTTCCTGC | 27028 | TGCAA | AGTTTTCTTTCTTCTTTTCAT | 27382 | CCCAG |
| 107 | GAGCGCCATCTTTTCCTGCTG | 27029 | CAAG | GTTTTCTTTCTTCTTTTCATC | 27383 | CCAG |
| 110 | CACAATGAGCGCCATCTTTT | 27030 | CCT | CTTTGAGTTTTCTTTCTTCT | 27384 | TTT |
| 112 | GGCGCTCATTGTGCCTGGCA | 27031 | ACT | AGAAAACTCAAAGCTCATCA | 27385 | CCA |
| 115 | ATGAGCGCCATCTTTTCCTGC | 27032 | TGCAA | AGTTTTCTTTCTTCTTTTCAT | 27386 | CCCAG |
| 116 | CAATGAGCGCCATCTTTTCC | 27033 | TG | TTCTTTCTTCTTTTCATCCC | 27387 | AG |
| 119 | CGCTCATTGTGCCTGGCAAC | 27034 | TG | AACTCAAAGCTCATCACCAC | 27388 | TG |
| 123 | ACAATGAGCGCCATCTTTTC | 27035 | CTG | TTTGAGTTTTCTTTCTTCTT | 27389 | TTC |
| 125 | GCGCTCATTGTGCCTGGCAA | 27036 | CTG | GAAAACTCAAAGCTCATCAC | 27390 | CAC |
| 132 | tgAGCGCCATCTTTTCCTGCTGC | 27037 | AAGAA | ctCTGACTCAGTGGTGATGAGCT | 27391 | TTGAGT |
| 133 | ATGAGCGCCATCTTTTCCTGC | 27038 | TGCAA | AGTTTTCTTTCTTCTTTTCAT | 27392 | CCCAG |
| 136 | ACAATGAGCGCCATCTTTTC | 27039 | CTG | TTTCTTTCTTCTTTTCATCC | 27393 | CAG |
| 137 | CTTTTCCTGCTGCAAGAATG | 27040 | AGG | CTTTTCATCCCAGCTTGCAC | 27394 | TGG |
| 140 | CAATGAGCGCCATCTTTTCC | 27041 | TGC | TTGAGTTTTCTTTCTTCTTT | 27395 | TCA |

TABLE 2B-continued

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 143 | CGCTCATTGTGCCTGGCAAC | 27042 | TGG | AAACTCAAAGCTCATCACCA | 27396 | CTG |
| 144 | CGCTCATTGTGCCTGGCAAC | 27043 | TGG | GCTCATCACCACTGAGTCAG | 27397 | AGG |
| 147 | CGCTCATTGTGCCTGGCAAC | 27044 | TGG | AAAACTCAAAGCTCATCACC | 27398 | ACT |
| 148 | CAATGAGCGCCATCTTTTCC | 27045 | TG | TTCTTTCTTCTTTTCATCCC | 27399 | AG |
| 151 | CGCTCATTGTGCCTGGCAAC | 27046 | TG | AACTCAAAGCTCATCACCAC | 27400 | TG |
| 154 | gcgcTCATTGTGCCTGGCAACTG | 27047 | GTAGCTGG | aaaaCTCAAAGCTCATCACCACT | 27401 | GAGTCAGA |
| 160 | gcAGCAGGAAAAGATGGCGCTCAT | 27048 | TGTGCC | aaGAAGAAAGAAAACTCAAAGCTC | 27402 | ATCACC |
| 161 | tgAGCGCCATCTTTTCCTGCTGC | 27049 | AAGAA | ctCTGACTCAGTGGTGATGAGCT | 27403 | TTGAGT |
| 162 | ATGAGCGCCATCTTTTCCTGC | 27050 | TGCAA | AGTTTTCTTTCTTCTTTTCAT | 27404 | CCCAG |
| 163 | ATCTTTTCCTGCTGCAAGAAT | 27051 | GAGG | TTCTTTTCATCCCAGCTTGCA | 27405 | CTGG |
| 164 | GAGCGCCATCTTTTCCTGCTG | 27052 | CAAG | GTTTTCTTTCTTCTTTTCATC | 27406 | CCAG |
| 165 | GGCGCTCATTGTGCCTGGCAA | 27053 | CTGG | AAGCTCATCACCACTGAGTCA | 27407 | GAGG |
| 166 | GCTCATTGTGCCTGGCAACTG | 27054 | GTAG | AAACTCAAAGCTCATCACCAC | 27408 | TGAG |
| 169 | ATGAGCGCCATCTTTTCCTG | 27055 | CTG | TTTCTTTCTTCTTTTCATCC | 27409 | CAG |
| 170 | AATGAGCGCCATCTTTTCCT | 27056 | GCT | TGAGTTTTCTTTCTTCTTTT | 27410 | CAT |
| 173 | CGCTCATTGTGCCTGGCAAC | 27057 | TGG | AAACTCAAAGCTCATCACCA | 27411 | CTG |
| 174 | GCTCATTGTGCCTGGCAACT | 27058 | GGT | AAACTCAAAGCTCATCACCA | 27412 | CTG |
| 175 | gcgcTCATTGTGCCTGGCAACTG | 27059 | GTAGCTGG | aaaaCTCAAAGCTCATCACCACT | 27413 | GAGTCAGA |
| 176 | gcgcTCATTGTGCCTGGCAACTG | 27060 | GTAGCTGG | aaaaCTCAAAGCTCATCACCACT | 27414 | GAGTCAGA |
| 179 | ATGAGCGCCATCTTTTCCTGC | 27061 | TGCAA | AGTTTTCTTTCTTCTTTTCAT | 27415 | CCCAG |
| 180 | CGCTCATTGTGCCTGGCAACT | 27062 | GGTAG | AAAACTCAAAGCTCATCACCA | 27416 | CTGAGT |
| 181 | TGAGCGCCATCTTTTCCTGC | 27063 | TG | TTCTTTCTTCTTTTCATCCC | 27417 | AG |

TABLE 2B-continued

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 185 | ATGAGCGCCATCTTTTCCTG | 27064 | CTG | GAGTTTTCTTTCTTCTTTTC | 27418 | ATC |
| 186 | CTCATTGTGCCTGGCAACTG | 27065 | GTA | AACTCAAAGCTCATCACCAC | 27419 | TGA |
| 189 | ATGAGCGCCATCTTTTCCTG | 27066 | CTG | TTTCTTTCTTCTTTTCATCC | 27420 | CAG |
| 190 | TGAGCGCCATCTTTTCCTGC | 27067 | TGC | AGTTTTCTTTCTTCTTTTCA | 27421 | TCC |
| 191 | TCATTGTGCCTGGCAACTGG | 27068 | TAG | ACTCAAAGCTCATCACCACT | 27422 | GAG |
| 193 | GAGCGCCATCTTTTCCTGCTG | 27069 | CAAG | GTTTTCTTTCTTCTTTTCATC | 27423 | CCAG |
| 194 | CATTGTGCCTGGCAACTGGT | 27070 | AG | CTCAAAGCTCATCACCACTG | 27424 | AG |
| 198 | CATTGTGCCTGGCAACTGGT | 27071 | AGC | CTCAAAGCTCATCACCACTG | 27425 | AGT |
| 199 | GAGCGCCATCTTTTCCTGCT | 27072 | GCA | GTTTTCTTTCTTCTTTTCAT | 27426 | CCC |
| 203 | GAGCGCCATCTTTTCCTGCTG | 27073 | CAAGA | AGTTTTCTTTCTTCTTTTCAT | 27427 | CCCAG |
| 204 | GAGCGCCATCTTTTCCTGCTG | 27074 | CAAGA | AGTTTTCTTTCTTCTTTTCAT | 27428 | CCCAG |
| 209 | TTGTGCCTGGCAACTGGTAG | 27075 | CTG | ACTCAAAGCTCATCACCACT | 27429 | GAG |
| 210 | TGTGCCTGGCAACTGGTAGC | 27076 | TGG | GCTCATCACCACTGAGTCAG | 27430 | AGG |
| 213 | ATTGTGCCTGGCAACTGGTA | 27077 | GCT | TCAAAGCTCATCACCACTGA | 27431 | GTC |
| 214 | TGAGCGCCATCTTTTCCTGC | 27078 | TG | TTCTTTCTTCTTTTCATCCC | 27432 | AG |
| 217 | CATTGTGCCTGGCAACTGGT | 27079 | AG | CTCAAAGCTCATCACCACTG | 27433 | AG |
| 221 | AGCGCCATCTTTTCCTGCTG | 27080 | CAA | TTTTCTTTCTTCTTTTCATC | 27434 | CCA |
| 222 | gcgcTCATTGTGCCTGGCAACTG | 27081 | GTAGCTGG | aaaaCTCAAAGCTCATCACCACT | 27435 | GAGTCAGA |
| 223 | gcgcTCATTGTGCCTGGCAACTG | 27082 | GTAGCTGG | aaaaCTCAAAGCTCATCACCACT | 27436 | GAGTCAGA |
| 226 | gcAGCAGGAAAAGATGGCGCTCAT | 27083 | TGTGCC | aaGAAGAAAGAAAACTCAAAGCTC | 27437 | ATCACC |
| 227 | ATTGTGCCTGGCAACTGGTAG | 27084 | CTGG | AAGCTCATCACCACTGAGTCA | 27438 | GAGG |
| 228 | ATTGTGCCTGGCAACTGGTAG | 27085 | CTGG | TCAAAGCTCATCACCACTGAG | 27439 | TCAG |

TABLE 2B-continued

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 231 | GCGCCATCTTTTCCTGCTGC | 27086 | AAG | TTTCTTTCTTCTTTTCATCC | 27440 | CAG |
| 232 | GCGCCATCTTTTCCTGCTGC | 27087 | AAG | TTTCTTTCTTCTTTTCATCC | 27441 | CAG |
| 235 | TTGTGCCTGGCAACTGGTAG | 27088 | CTG | AAAGCTCATCACCACTGAGT | 27442 | CAG |
| 236 | TTGTGCCTGGCAACTGGTAG | 27089 | CTG | CAAAGCTCATCACCACTGAG | 27443 | TCA |
| 237 | gcgcTCATTGTGCCTGGCAACTG | 27090 | GTAGCTGG | aaaaCTCAAAGCTCATCACCACT | 27444 | GAGTCAGA |
| 238 | gcgcTCATTGTGCCTGGCAACTG | 27091 | GTAGCTGG | aaaaCTCAAAGCTCATCACCACT | 27445 | GAGTCAGA |
| 239 | TTGTGCCTGGCAACTGGTAGC | 27092 | TGGAG | CAAAGCTCATCACCACTGAGT | 27446 | CAGAG |
| 240 | CGCCATCTTTTCCTGCTGCA | 27093 | AG | TTCTTTCTTCTTTTCATCCC | 27447 | AG |
| 243 | TGTGCCTGGCAACTGGTAGC | 27094 | TG | AAGCTCATCACCACTGAGTC | 27448 | AG |
| 247 | CGCCATCTTTTCCTGCTGCA | 27095 | AGA | TTCTTTCTTCTTTTCATCCC | 27449 | AGC |
| 249 | TGTGCCTGGCAACTGGTAGC | 27096 | TGG | AAAGCTCATCACCACTGAGT | 27450 | CAG |
| 250 | cacaATGAGCGCCATCTTTTCCT | 27097 | GCTGC | gagtTTTCTTTCTTCTTTTCATC | 27451 | CCAGCTTG |
| 251 | cacaATGAGCGCCATCTTTTCCT | 27098 | GCTGC | gagtTTTCTTTCTTCTTTTCATC | 27452 | CCAGCTTG |
| 254 | GCGCCATCTTTTCCTGCTGC | 27099 | AAG | TTTCTTTCTTCTTTTCATCC | 27453 | CAG |
| 255 | GCCATCTTTTCCTGCTGCAA | 27100 | GAA | TCTTTCTTCTTTTCATCCCA | 27454 | GCT |
| 258 | TGTGCCTGGCAACTGGTAGC | 27101 | TGG | AGCTCATCACCACTGAGTCA | 27455 | GAG |
| 259 | TGTGCCTGGCAACTGGTAGC | 27102 | TGG | GCTCATCACCACTGAGTCAG | 27456 | AGG |
| 262 | GTGCCTGGCAACTGGTAGCT | 27103 | GGA | AAGCTCATCACCACTGAGTC | 27457 | AGA |
| 263 | GTGCCTGGCAACTGGTAGCT | 27104 | GG | AAGCTCATCACCACTGAGTC | 27458 | AG |
| 267 | GTGCCTGGCAACTGGTAGCTG | 27105 | GAGG | AAGCTCATCACCACTGAGTCA | 27459 | GAGG |
| 268 | GTGCCTGGCAACTGGTAGCTG | 27106 | GAGG | AAGCTCATCACCACTGAGTCA | 27460 | GAGG |
| 271 | TGCCTGGCAACTGGTAGCTG | 27107 | GAG | AGCTCATCACCACTGAGTCA | 27461 | GAG |

TABLE 2B-continued

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 272 | GCCTGGCAACTGGTAGCTGG | 27108 | AGG | GCTCATCACCACTGAGTCAG | 27462 | AGG |
| 275 | TGCCTGGCAACTGGTAGCTG | 27109 | GAG | AGCTCATCACCACTGAGTCA | 27463 | GAG |
| 276 | CGCCATCTTTTCCTGCTGCA | 27110 | AG | TTCTTTCTTCTTTTCATCCC | 27464 | AG |
| 279 | GTGCCTGGCAACTGGTAGCT | 27111 | GG | AAGCTCATCACCACTGAGTC | 27465 | AG |
| 283 | CCATCTTTTCCTGCTGCAAG | 27112 | AAT | CTTTCTTCTTTTCATCCCAG | 27466 | CTT |
| 286 | ttGTGCCTGGCAACTGGTAGCTG | 27113 | GAGGA | ctCAAAGCTCATCACCACTGAGT | 27467 | CAGAG |
| 287 | GTGCCTGGCAACTGGTAGCTG | 27114 | GAGGA | AAAGCTCATCACCACTGAGTC | 27468 | AGAGG |
| 288 | ttGTGCCTGGCAACTGGTAGCTG | 27115 | GAGGA | ctCAAAGCTCATCACCACTGAGT | 27469 | CAGAG |
| 289 | GTGCCTGGCAACTGGTAGCTG | 27116 | GAGGA | AAAGCTCATCACCACTGAGTC | 27470 | AGAGG |
| 292 | GTGCCTGGCAACTGGTAGCTG | 27117 | GAGG | AAGCTCATCACCACTGAGTCA | 27471 | GAGG |
| 293 | GTGCCTGGCAACTGGTAGCTG | 27118 | GAGG | AAGCTCATCACCACTGAGTCA | 27472 | GAGG |
| 296 | CATCTTTTCCTGCTGCAAGA | 27119 | ATG | TTTCTTCTTTTCATCCCAGC | 27473 | TTG |
| 297 | CATCTTTTCCTGCTGCAAGA | 27120 | ATG | TTTCTTCTTTTCATCCCAGC | 27474 | TTG |
| 300 | GCCTGGCAACTGGTAGCTGG | 27121 | AGG | GCTCATCACCACTGAGTCAG | 27475 | AGG |
| 301 | GCCTGGCAACTGGTAGCTGG | 27122 | AGG | GCTCATCACCACTGAGTCAG | 27476 | AGG |
| 302 | CCTGGCAACTGGTAGCTGGAG | 27123 | GACAGT | CATCACCACTGAGTCAGAGGC | 27477 | ACTAG |
| 303 | ATCTTTTCCTGCTGCAAGAA | 27124 | TGA | TTCTTCTTTTCATCCCAGCT | 27478 | TGC |
| 304 | CCTGGCAACTGGTAGCTGGA | 27125 | GGA | CTCATCACCACTGAGTCAGA | 27479 | GGC |
| 305 | TCTTTTCCTGCTGCAAGAAT | 27126 | GAG | TCTTCTTTTCATCCCAGCTT | 27480 | GCA |
| 306 | CTGGCAACTGGTAGCTGGAG | 27127 | GAC | TCATCACCACTGAGTCAGAG | 2781 | GCA |
| 308 | CTTTTCCTGCTGCAAGAATG | 27128 | AGG | CTTCTTTTCATCCCAGCTTG | 27482 | CAC |

TABLE 2B-continued

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 309 | TGGCAACTGGTAGCTGGAGG | 27129 | ACA | CATCACCACTGAGTCAGAGG | 27483 | CAC |
| 310 | TTTTCCTGCTGCAAGAATGA | 27130 | GG | CTTTTCATCCCAGCTTGCAC | 27484 | TG |
| 314 | TTTTCCTGCTGCAAGAATGA | 27131 | GGT | TTCTTTTCATCCCAGCTTGC | 27485 | ACT |
| 315 | GGCAACTGGTAGCTGGAGGA | 27132 | CAG | ATCACCACTGAGTCAGAGGC | 27486 | ACT |
| 316 | tcctGCTGCAAGAATGAGGTTTG | 27133 | GGTTCATT | tcttTCTTCTTTTCATCCCAGCT | 27487 | TGCACTGG |
| 317 | tcctGCTGCAAGAATGAGGTTTG | 27134 | GGTTCATT | tcttTCTTCTTTTCATCCCAGCT | 27488 | TGCACTGG |
| 321 | CTTTTCCTGCTGCAAGAATG | 27135 | AGG | TCTTTTCATCCCAGCTTGCA | 27489 | CTG |
| 322 | TTTCCTGCTGCAAGAATGAG | 27136 | GTT | TCTTTTCATCCCAGCTTGCA | 27490 | CTG |
| 323 | GCAACTGGTAGCTGGAGGAC | 27137 | AGT | TCACCACTGAGTCAGAGGCA | 27491 | CTA |
| 324 | ctggCAACTGGTAGCTGGAGGAC | 27138 | AGTAC | caccACTGAGTCAGAGGCACTAG | 27492 | GAGAC |
| 325 | ctggCAACTGGTAGCTGGAGGAC | 27139 | AGTAC | caccACTGAGTCAGAGGCACTAG | 27493 | GAGAC |
| 327 | TTCCTGCTGCAAGAATGAGG | 27140 | TTT | CTTTTCATCCCAGCTTGCAC | 27494 | TGG |
| 329 | CAACTGGTAGCTGGAGGACA | 27141 | GTA | CACCACTGAGTCAGAGGCAC | 27495 | TAG |
| 332 | CCTGCTGCAAGAATGAGGTT | 27142 | TG | TTTTCATCCCAGCTTGCACT | 27496 | GG |
| 335 | GCAACTGGTAGCTGGAGGAC | 27143 | AG | ACCACTGAGTCAGAGGCACT | 27497 | AG |
| 339 | TCCTGCTGCAAGAATGAGGT | 27144 | TTG | TTTTCATCCCAGCTTGCACT | 27498 | GGT |
| 341 | AACTGGTAGCTGGAGGACAG | 27145 | TAC | ACCACTGAGTCAGAGGCACT | 27499 | AGG |
| 350 | CCTGCTGCAAGAATGAGGTT | 27146 | TGG | CTTTTCATCCCAGCTTGCAC | 27500 | TGG |
| 351 | CCTGCTGCAAGAATGAGGTT | 27147 | TGG | TTTCATCCCAGCTTGCACTG | 27501 | GTT |
| 354 | GTAGCTGGAGGACAGTACTC | 27148 | ACG | ACCACTGAGTCAGAGGCACT | 27502 | AGG |
| 355 | TAGCTGGAGGACAGTACTCA | 27149 | CGG | ACCACTGAGTCAGAGGCACT | 27503 | AGG |

TABLE 2B-continued

Exemplary left gRNA spacer and right gRNA spacer pairs
Table 2B provides exemplified second-nick gRNA species for optional use for correcting the pathogenic R261Q mutation in PAH. The gRNA spacers from Table 1B were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 358 | ACTGGTAGCTGGAGGACAGT | 27150 | ACT | CCACTGAGTCAGAGGCACTA | 27504 | GGA |
| 359 | GCAACTGGTAGCTGGAGGAC | 27151 | AG | CCACTGAGTCAGAGGCACTA | 27505 | GG |

TABLE 2C

Exemplary left gRNA spacer and right gRNA spacer pairs
Table 2C provides exemplified second-nick gRNA species for optional use for correcting the pathogenic R243Q mutation in PAH. The gRNA spacers from Table 1C were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 3 | CACGGTTCGGGGGTATACAT | 27683 | GGG | GAGACCTTTAGGTAGTGGAG | 28053 | TAG |
| 4 | ACGGTTCGGGGGTATACATG | 27684 | GGC | ACCTTTAGGTAGTGGAGTAG | 28054 | TAC |
| 5 | ACTGCACACAGTACATCAGAC | 27685 | ATGG | TGTGTACTACTCCACTACCTA | 28055 | AAGG |
| 6 | CCCATGTATACCCCCGAACCG | 27686 | TGAG | ATGTGTACTACTCCACTACCT | 28056 | AAAG |
| 9 | ATCCAAGCCCATGTATACCC | 27687 | CCG | GTGTACTACTCCACTACCTA | 28057 | AAG |
| 10 | TGGATCCAAGCCCATGTATA | 27688 | CCC | CAGTTATGTGTACTACTCCA | 28058 | CTA |
| 11 | CGGTTCGGGGGTATACATGG | 27689 | GCT | CCTTTAGGTAGTGGAGTAGT | 28059 | ACA |
| 12 | acatGGATCCAAGCCCATGTATA | 27690 | CCCCCGAA | gggcAGTTATGTGTACTACTCCA | 28060 | CTACCTAA |
| 13 | acatGGATCCAAGCCCATGTATA | 27691 | CCCCCGAA | gggcAGTTATGTGTACTACTCCA | 28061 | CTACCTAA |
| 14 | GGATCCAAGCCCATGTATACC | 27692 | CCCGA | GTTATGTGTACTACTCCACTA | 28062 | CCTAA |
| 15 | CCCATGTATACCCCCGAACCG | 27693 | TGAG | ATGTGTACTACTCCACTACCT | 28063 | AAAG |
| 17 | TCCAAGCCCATGTATACCCC | 27694 | CG | TGTACTACTCCACTACCTAA | 28064 | AG |
| 21 | GGATCCAAGCCCATGTATAC | 27695 | CCC | AGTTATGTGTACTACTCCAC | 28065 | TAC |
| 22 | GGTTCGGGGGTATACATGGG | 27696 | CTT | CTTTAGGTAGTGGAGTAGTA | 28066 | CAC |

TABLE 2C-continued

Exemplary left gRNA spacer and right gRNA spacer pairs
Table 2C provides exemplified second-nick gRNA species for optional use for correcting the pathogenic R243Q mutation in PAH. The gRNA spacers from Table 1C were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 25 | tgGATCCAAGCCCATGTAT ACCC | 27697 | CCGAA | gcCTAGCGTCAAAGCCTAT GTCC | 28067 | CTGGG |
| 26 | GGATCCAAGCCCATGTAT ACC | 27698 | CCCGA | GTTATGTGTACTACTCCA CTA | 28068 | CCTAA |
| 29 | ATCCAAGCCCATGTATAC CC | 27699 | CCG | GTGTACTACTCCACTACC TA | 28069 | AAG |
| 30 | TGCACACAGTACATCAGA CA | 27700 | TGG | TGTACTACTCCACTACCT AA | 28070 | AGG |
| 33 | GATCCAAGCCCATGTATA CC | 27701 | CCC | GTTATGTGTACTACTCCA CT | 28071 | ACC |
| 34 | TCCAAGCCCATGTATACC CC | 27702 | CG | TGTACTACTCCACTACCT AA | 28072 | AG |
| 37 | GTTCGGGGGTATACATGG GC | 27703 | TTG | TTTAGGTAGTGGAGTAGT AC | 28073 | ACA |
| 42 | tgGATCCAAGCCCATGTAT ACCC | 27704 | CCGAA | gcCTAGCGTCAAAGCCTAT GTCC | 28074 | CTGGG |
| 43 | GATCCAAGCCCATGTATA CCC | 27705 | CCGAA | GTTATGTGTACTACTCCA CTA | 28075 | CCTAA |
| 44 | ACTGCACACAGTACATCA GAC | 27706 | ATGG | TGTGTACTACTCCACTAC CTA | 28076 | AAGG |
| 45 | CCCATGTATACCCCCGAA CCG | 27707 | TGAG | ATGTGTACTACTCCACTA CCT | 28077 | AAAG |
| 48 | ATCCAAGCCCATGTATAC CC | 27708 | CCG | GTGTACTACTCCACTACC TA | 28078 | AAG |
| 49 | ATCCAAGCCCATGTATAC CC | 27709 | CCG | TTATGTGTACTACTCCACT A | 28079 | CCT |
| 50 | TTCGGGGGTATACATGGG CT | 27710 | TGG | TTAGGTAGTGGAGTAGTA CA | 28080 | CAT |
| 51 | ggttCGGGGGTATACATGG GCTT | 27711 | GGATC | ctttAGGTAGTGGAGTAGTA CAC | 28081 | ATAAC |
| 52 | ggttCGGGGGTATACATGG GCTT | 27712 | GGATC | ctttAGGTAGTGGAGTAGTA CAC | 28082 | ATAAC |
| 57 | cgGTTCGGGGGTATACATG GGCTT | 27713 | GGATCC | ttAGGTAGTGGAGTAGTAC ACATA | 28083 | ACTGCC |
| 58 | GATCCAAGCCCATGTATA CCC | 27714 | CCGAA | TTATGTGTACTACTCCACT AC | 28084 | CTAAA |
| 59 | TCCAAGCCCATGTATACC CC | 27715 | CGA | TATGTGTACTACTCCACT AC | 28085 | CTA |
| 60 | TCGGGGGTATACATGGGC TT | 27716 | GGA | TAGGTAGTGGAGTAGTAC AC | 28086 | ATA |
| 61 | ggttCGGGGGTATACATGG GCTT | 27717 | GGATC | ctttAGGTAGTGGAGTAGTA CAC | 28087 | ATAAC |
| 62 | ggttCGGGGGTATACATGG GCTT | 27718 | GGATC | ctttAGGTAGTGGAGTAGTA CAC | 28088 | ATAAC |

TABLE 2C-continued

Exemplary left gRNA spacer and right gRNA spacer pairs
Table 2C provides exemplified second-nick gRNA species for optional use for correcting the pathogenic R243Q mutation in PAH. The gRNA spacers from Table 1C were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 64 | GGTTCGGGGGTATACATGGGC | 27719 | TTGGAT | TTTAGGTAGTGGAGTAGTACA | 28089 | CATAA |
| 65 | TCCAAGCCCATGTATACCCC | 27720 | CG | TGTACTACTCCACTACCTAA | 28090 | AG |
| 69 | CCAAGCCCATGTATACCCCC | 27721 | GAA | ATGTGTACTACTCCACTACC | 28091 | TAA |
| 70 | CGGGGGTATACATGGGCTTG | 27722 | GAT | AGGTAGTGGAGTAGTACACA | 28092 | TAA |
| 76 | AGCCCATGTATACCCCCGAA | 27723 | CCG | GTGTACTACTCCACTACCTA | 28093 | AAG |
| 77 | TGCACACAGTACATCAGACA | 27724 | TGG | TGTACTACTCCACTACCTAA | 28094 | AGG |
| 80 | CAAGCCCATGTATACCCCCG | 27725 | AAC | TGTGTACTACTCCACTACCT | 28095 | AAA |
| 81 | TCCAAGCCCATGTATACCCC | 27726 | CG | TGTACTACTCCACTACCTAA | 28096 | AG |
| 84 | GGGGGTATACATGGGCTTGG | 27727 | ATC | GGTAGTGGAGTAGTACACAT | 28097 | AAC |
| 86 | ACTGCACACAGTACATCAGAC | 27728 | ATGG | TGTGTACTACTCCACTACCTA | 28098 | AAGG |
| 87 | CCCATGTATACCCCCGAACCG | 27729 | TGAG | TGTGTACTACTCCACTACCTA | 28099 | AAGG |
| 90 | AGCCCATGTATACCCCCGAA | 27730 | CCG | GTGTACTACTCCACTACCTA | 28100 | AAG |
| 91 | AAGCCCATGTATACCCCCGA | 27731 | ACC | GTGTACTACTCCACTACCTA | 28101 | AAG |
| 92 | GGGGTATACATGGGCTTGGA | 27732 | TCC | GTAGTGGAGTAGTACACATA | 28102 | ACT |
| 93 | gttcGGGGGTATACATGGGCTTG | 27733 | GATCCATG | taggTAGTGGAGTAGTACACATA | 28103 | ACTGC |
| 96 | cgGTTCGGGGGTATACATGGGCTT | 27734 | GGATCC | taGGTAGTGGAGTAGTACACATAA | 28104 | CTGCCC |
| 97 | aacCGTGAGTACTGTCCTCCAGCT | 27735 | ACCAGTT | ctaGCGTCAAAGCCTATGTCCCTG | 28105 | GGCAGTT |
| 98 | AGCCCATGTATACCCCCGAAC | 27736 | CGTGA | ATGTGTACTACTCCACTACCT | 28106 | AAAGGT |
| 99 | AGCCCATGTATACCCCCGAAC | 27737 | CGTGA | ATGTGTACTACTCCACTACCT | 28107 | AAAGGT |
| 102 | CCCATGTATACCCCCGAACCG | 27738 | TGAG | TGTGTACTACTCCACTACCTA | 28108 | AAGG |
| 103 | AGCCCATGTATACCCCCGAA | 27739 | CCG | TGTACTACTCCACTACCTAA | 28109 | AGG |
| 104 | GGGTATACATGGGCTTGGAT | 27740 | CCA | TAGTGGAGTAGTACACATAA | 28110 | CTG |

TABLE 2C-continued

Exemplary left gRNA spacer and right gRNA spacer pairs
Table 2C provides exemplified second-nick gRNA species for optional use for correcting the pathogenic R243Q mutation in PAH. The gRNA spacers from Table 1C were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 105 | ggggTATACATGGGCTTGGATCC | 27741 | ATGTCTGA | aggtAGTGGAGTAGTACACATAA | 28111 | CTGCCCAG |
| 106 | ggggTATACATGGGCTTGGATCC | 27742 | ATGTCTGA | aggtAGTGGAGTAGTACACATAA | 28112 | CTGCCCAG |
| 107 | ggggTATACATGGGCTTGGATCC | 27743 | ATGTCTGA | aggtAGTGGAGTAGTACACATAA | 28113 | CTGCCCAG |
| 108 | AGCCCATGTATACCCCCGAAC | 27744 | CGTGA | ATGTGTACTACTCCACTACCT | 28114 | AAAGGT |
| 109 | TATACATGGGCTTGGATCCA | 27745 | TG | AGTGGAGTAGTACACATAAC | 28115 | TG |
| 112 | GCCCATGTATACCCCCGAAC | 27746 | CGT | GTACTACTCCACTACCTAAA | 28116 | GGT |
| 114 | GGTATACATGGGCTTGGATC | 27747 | CAT | AGTGGAGTAGTACACATAAC | 28117 | TGC |
| 121 | GTATACATGGGCTTGGATCC | 27748 | ATG | TAGTGGAGTAGTACACATAA | 28118 | CTG |
| 122 | GTATACATGGGCTTGGATCC | 27749 | ATG | GTGGAGTAGTACACATAACT | 28119 | GCC |
| 123 | CCCATGTATACCCCCGAACC | 27750 | GTG | TACTACTCCACTACCTAAAG | 28120 | GTC |
| 124 | ggggTATACATGGGCTTGGATCC | 27751 | ATGTC | ggtaGTGGAGTAGTACACATAAC | 28121 | TGCCC |
| 126 | cgGTTCGGGGGTATACATGGGCTT | 27752 | GGATCC | taGGTAGTGGAGTAGTACACATAA | 28122 | CTGCCC |
| 127 | CCATGTATACCCCCGAACCG | 27753 | TGA | ACTACTCCACTACCTAAAGG | 28123 | TCT |
| 128 | TATACATGGGCTTGGATCCA | 27754 | TGT | TGGAGTAGTACACATAACTG | 28124 | CCC |
| 129 | cccaTGTATACCCCCGAACCGTG | 27755 | AGTAC | tgtaCTACTCCACTACCTAAAGG | 28125 | TCTCCTAG |
| 130 | cccaTGTATACCCCCGAACCGTG | 27756 | AGTAC | tgtaCTACTCCACTACCTAAAGG | 28126 | TCTCCTAG |
| 131 | ggggTATACATGGGCTTGGATCC | 27757 | ATGTC | ggtaGTGGAGTAGTACACATAAC | 28127 | TGCCC |
| 132 | ATGTATACCCCCGAACCGTG | 27758 | AG | GTACTACTCCACTACCTAAA | 28128 | GG |
| 136 | CATGTATACCCCCGAACCGT | 27759 | GAG | CTACTCCACTACCTAAAGGT | 28129 | CTC |
| 137 | ATACATGGGCTTGGATCCAT | 27760 | GTC | GGAGTAGTACACATAACTGC | 28130 | CCA |
| 141 | CATGTATACCCCCGAACCGT | 27761 | GAG | TCCACTACCTAAAGGTCTCC | 28131 | TAG |
| 142 | ATGTATACCCCCGAACCGTG | 27762 | AGT | TACTCCACTACCTAAAGGTC | 28132 | TCC |

TABLE 2C-continued

Exemplary left gRNA spacer and right gRNA spacer pairs
Table 2C provides exemplified second-nick gRNA species for optional use for correcting the pathogenic R243Q mutation in PAH. The gRNA spacers from Table 1C were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 143 | TACATGGGCTTGGATCCATG | 27763 | TCT | GAGTAGTACACATAACTGCC | 28133 | CAG |
| 144 | cccaTGTATACCCCCGAACCGTG | 27764 | AGTAC | tgtaCTACTCCACTACCTAAAGG | 28134 | TCTCCTAG |
| 145 | ggggTATACATGGGCTTGGATCC | 27765 | ATGTC | ggagTAGTACACATAACTGCCCA | 28135 | GGGAC |
| 148 | atGTATACCCCCGAACCGTGAGTA | 27766 | CTGTCC | taCTCCACTACCTAAAGGTCTCCT | 28136 | AGTGCC |
| 149 | cgGTTCGGGGGTATACATGGGCTT | 27767 | GGATCC | taGGTAGTGGAGTAGTACACATAA | 28137 | CTGCCC |
| 150 | CCCATGTATACCCCCGAACCG | 27768 | TGAG | ACTCCACTACCTAAAGGTCTC | 28138 | CTAG |
| 151 | TGTATACCCCCGAACCGTGA | 27769 | GTA | ACTCCACTACCTAAAGGTCT | 28139 | CCT |
| 152 | ACATGGGCTTGGATCCATGT | 27770 | CTG | AGTAGTACACATAACTGCCC | 28140 | AGG |
| 153 | cccaTGTATACCCCCGAACCGTG | 27771 | AGTAC | actcCACTACCTAAAGGTCTCCT | 28141 | AGTGC |
| 154 | catgGGCTTGGATCCATGTCTGA | 27772 | TGTACTGT | ggagTAGTACACATAACTGCCCA | 28142 | GGGAC |
| 155 | GCCCATGTATACCCCCGAACC | 27773 | GTGAGT | TACTCCACTACCTAAAGGTCT | 28143 | CCTAGT |
| 156 | CATGGGCTTGGATCCATGTC | 27774 | TG | GTAGTACACATAACTGCCCA | 28144 | GG |
| 160 | CATGGGCTTGGATCCATGTC | 27775 | TGA | GTAGTACACATAACTGCCCA | 28145 | GGG |
| 161 | GTATACCCCCGAACCGTGAG | 27776 | TAC | CTCCACTACCTAAAGGTCTC | 28146 | CTA |
| 167 | TGGGCTTGGATCCATGTCTG | 27777 | ATG | GTAGTACACATAACTGCCCA | 28147 | GGG |
| 168 | TTCGGGGGTATACATGGGCT | 27778 | TGG | GTAGTACACATAACTGCCCA | 28148 | GGG |
| 171 | ATGGGCTTGGATCCATGTCT | 27779 | GAT | TAGTACACATAACTGCCCAG | 28149 | GGA |
| 172 | TACCCCCGAACCGTGAGTAC | 27780 | TG | CCACTACCTAAAGGTCTCCT | 28150 | AG |
| 175 | CATGGGCTTGGATCCATGTC | 27781 | TG | TAGTACACATAACTGCCCAG | 28151 | GG |
| 179 | TATACCCCCGAACCGTGAGT | 27782 | ACT | TCCACTACCTAAAGGTCTCC | 28152 | TAG |
| 183 | ATGTCTGATGTACTGTGTGCA | 27783 | GTGG | GAGTAGTACACATAACTGCCC | 28153 | AGGG |

TABLE 2C-continued

Exemplary left gRNA spacer and right gRNA spacer pairs
Table 2C provides exemplified second-nick gRNA species for optional use for correcting the pathogenic R243Q mutation in PAH. The gRNA spacers from Table 1C were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 184 | TCCATGTCTGATGTACTG TGT | 27784 | GCAG | GAGTAGTACACATAACTG CCC | 28154 | AGGG |
| 187 | ATACCCCCGAACCGTGAG TA | 27785 | CTG | CACTACCTAAAGGTCTCC TA | 28155 | GTG |
| 188 | TCCTCCAGCTACCAGTTG CC | 27786 | AGG | TGTACTACTCCACTACCT AA | 28156 | AGG |
| 191 | ATACCCCCGAACCGTGAG TA | 27787 | CTG | CCACTACCTAAAGGTCTC CT | 28157 | AGT |
| 194 | TGGGCTTGGATCCATGTC TG | 27788 | ATG | GTAGTACACATAACTGCC CA | 28158 | GGG |
| 195 | TGGGCTTGGATCCATGTC TG | 27789 | ATG | AGTACACATAACTGCCCA GG | 28159 | GAC |
| 196 | TACCCCCGAACCGTGAGT AC | 27790 | TG | CCACTACCTAAAGGTCTC CT | 28160 | AG |
| 199 | tgtaTACCCCCGAACCGTGA GTA | 27791 | CTGTC | actcCACTACCTAAAGGTCT CCT | 28161 | AGTGC |
| 203 | atGTATACCCCCGAACCGT GAGTA | 27792 | CTGTCC | taCTCCACTACCTAAAGGT CTCCT | 28162 | AGTGCC |
| 204 | aacTGGTAGCTGGAGGACA GTACT | 27793 | CACGGT T | | 28163 | |
| 205 | ATACATGGGCTTGGATCC ATG | 27794 | TCTGAT | GTACACATAACTGCCCAG GGA | 28164 | CATAG |
| 206 | ATACATGGGCTTGGATCC ATG | 27795 | TCTGAT | GTACACATAACTGCCCAG GGA | 28165 | CATAG |
| 207 | TGTCCTCCAGCTACCAGT TGC | 27796 | CAGG | TGTGTACTACTCCACTAC CTA | 28166 | AAGG |
| 208 | CCGAACCGTGAGTACTGT CCT | 27797 | CCAG | ACTCCACTACCTAAAGGT CTC | 28167 | CTAG |
| 211 | ATACCCCCGAACCGTGAG TA | 27798 | CTG | CACTACCTAAAGGTCTCC TA | 28168 | GTG |
| 212 | TACCCCCGAACCGTGAGT AC | 27799 | TGT | CACTACCTAAAGGTCTCC TA | 28169 | GTG |
| 213 | GGGCTTGGATCCATGTCT GA | 27800 | TGT | GTACACATAACTGCCCAG GG | 28170 | ACA |
| 214 | gtatACCCCCGAACCGTGAG TAC | 27801 | TGTCC | ctccACTACCTAAAGGTCTC CTA | 28171 | GTGCC |
| 215 | gtatACCCCCGAACCGTGAG TAC | 27802 | TGTCC | ctccACTACCTAAAGGTCTC CTA | 28172 | GTGCC |
| 217 | CCCGAACCGTGAGTACTG TCC | 27803 | TCCAG | ACCTAAAGGTCTCCTAGT GCC | 28173 | TCTGA |
| 218 | CCGAACCGTGAGTACTGT CCT | 27804 | CCAG | ACTCCACTACCTAAAGGT CTC | 28174 | CTAG |
| 219 | GGCTTGGATCCATGTCTG AT | 27805 | GTA | TACACATAACTGCCCAGG GA | 28175 | CAT |

TABLE 2C-continued

Exemplary left gRNA spacer and right gRNA spacer pairs
Table 2C provides exemplified second-nick gRNA species for optional use for correcting the pathogenic R243Q mutation in PAH. The gRNA spacers from Table 1C were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 220 | ACCCCCGAACCGTGAGTACT | 27806 | GTC | ACTACCTAAAGGTCTCCTAG | 28176 | TGC |
| 224 | CCCGAACCGTGAGTACTGTCC | 27807 | TCCAG | ACCTAAAGGTCTCCTAGTGCC | 28177 | TCTGA |
| 225 | TACCCCCGAACCGTGAGTAC | 27808 | TG | ACTACCTAAAGGTCTCCTAG | 28178 | TG |
| 229 | CCCCCGAACCGTGAGTACTG | 27809 | TCC | CTACCTAAAGGTCTCCTAGT | 28179 | GCC |
| 230 | GCTTGGATCCATGTCTGATG | 27810 | TAC | ACACATAACTGCCCAGGGAC | 28180 | ATA |
| 236 | GAACCGTGAGTACTGTCCTC | 27811 | CAG | CACTACCTAAAGGTCTCCTA | 28181 | GTG |
| 237 | CCCCGAACCGTGAGTACTGT | 27812 | CCT | TACCTAAAGGTCTCCTAGTG | 28182 | CCT |
| 238 | TGGATCCATGTCTGATGTAC | 27813 | TG | ACATAACTGCCCAGGGACAT | 28183 | AG |
| 242 | CTTGGATCCATGTCTGATGT | 27814 | ACT | CACATAACTGCCCAGGGACA | 28184 | TAG |
| 243 | catgGGCTTGGATCCATGTCTGA | 27815 | TGTACTGT | gtacACATAACTGCCCAGGGACA | 28185 | TAGGCTTT |
| 244 | catgGGCTTGGATCCATGTCTGA | 27816 | TGTACTGT | gtacACATAACTGCCCAGGGACA | 28186 | TAGGCTTT |
| 249 | CCGAACCGTGAGTACTGTCCT | 27817 | CCAG | ACTCCACTACCTAAAGGTCTC | 28187 | CTAG |
| 254 | TTGGATCCATGTCTGATGTA | 27818 | CTG | ACATAACTGCCCAGGGACAT | 28188 | AGG |
| 255 | TTGGATCCATGTCTGATGTA | 27819 | CTG | ACATAACTGCCCAGGGACAT | 28189 | AGG |
| 256 | CCCGAACCGTGAGTACTGTC | 27820 | CTC | ACCTAAAGGTCTCCTAGTGC | 28190 | CTC |
| 257 | taccCCCGAACCGTGAGTACTGT | 27821 | CCTCC | ccacTACCTAAAGGTCTCCTAGT | 28191 | GCCTC |
| 258 | taccCCCGAACCGTGAGTACTGT | 27822 | CCTCC | ccacTACCTAAAGGTCTCCTAGT | 28192 | GCCTC |
| 260 | CCCGAACCGTGAGTACTGTCC | 27823 | TCCAG | ACCTAAAGGTCTCCTAGTGCC | 28193 | TCTGA |
| 261 | CCGAACCGTGAGTACTGTCC | 27824 | TCC | CCTAAAGGTCTCCTAGTGCC | 28194 | TCT |
| 263 | TGGATCCATGTCTGATGTAC | 27825 | TGT | CATAACTGCCCAGGGACATA | 28195 | GGC |
| 264 | ttggATCCATGTCTGATGTACTG | 27826 | TGTGCAGT | gtacACATAACTGCCCAGGGACA | 28196 | TAGGCTTT |
| 269 | CCCGAACCGTGAGTACTGTCC | 27827 | TCCAG | ACCTAAAGGTCTCCTAGTGCC | 28197 | TCTGA |

TABLE 2C-continued

Exemplary left gRNA spacer and right gRNA spacer pairs
Table 2C provides exemplified second-nick gRNA species for optional use for correcting the pathogenic R243Q mutation in PAH. The gRNA spacers from Table 1C were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 270 | AACCGTGAGTACTGTCCTCC | 27828 | AG | TAAAGGTCTCCTAGTGCCTC | 28198 | TG |
| 274 | CGAACCGTGAGTACTGTCCT | 27829 | CCA | CTAAAGGTCTCCTAGTGCCT | 28199 | CTG |
| 275 | GGATCCATGTCTGATGTACT | 27830 | GTG | ATAACTGCCCAGGGACATAG | 28200 | GCT |
| 281 | aaGCCCATGTATACCCCCGAACC | 27831 | GTGAGT | ctAGTGCCTCTGACTCAGTGGTG | 28201 | ATGAG |
| 282 | CCCGAACCGTGAGTACTGTCC | 27832 | TCCAG | ACCTAAAGGTCTCCTAGTGCC | 28202 | TCTGA |
| 285 | GAACCGTGAGTACTGTCCTC | 27833 | CAG | CTAAAGGTCTCCTAGTGCCT | 28203 | CTG |
| 286 | TCCTCCAGCTACCAGTTGCC | 27834 | AGG | TCCTAGTGCCTCTGACTCAG | 28204 | TGG |
| 289 | GAACCGTGAGTACTGTCCTC | 27835 | CAG | TAAAGGTCTCCTAGTGCCTC | 28205 | TGA |
| 290 | AACCGTGAGTACTGTCCTCC | 27836 | AG | TAAAGGTCTCCTAGTGCCTC | 28206 | TG |
| 293 | GATCCATGTCTGATGTACTG | 27837 | TG | CATAACTGCCCAGGGACATA | 28207 | GG |
| 297 | GATCCATGTCTGATGTACTG | 27838 | TGT | TAACTGCCCAGGGACATAGG | 28208 | CTT |
| 303 | aaGCCCATGTATACCCCCGAACC | 27839 | GTGAGT | ctAGTGCCTCTGACTCAGTGGTG | 28209 | ATGAG |
| 304 | CCCGAACCGTGAGTACTGTCC | 27840 | TCCAG | AAGGTCTCCTAGTGCCTCTGA | 28210 | CTCAG |
| 305 | TGTCCTCCAGCTACCAGTTGC | 27841 | CAGG | TCTCCTAGTGCCTCTGACTCA | 28211 | GTGG |
| 306 | CCGAACCGTGAGTACTGTCCT | 27842 | CCAG | AGGTCTCCTAGTGCCTCTGAC | 28212 | TCAG |
| 309 | GAACCGTGAGTACTGTCCTC | 27843 | CAG | CTAAAGGTCTCCTAGTGCCT | 28213 | CTG |
| 310 | AACCGTGAGTACTGTCCTCC | 27844 | AGC | AAAGGTCTCCTAGTGCCTCT | 28214 | GAC |
| 313 | ATCCATGTCTGATGTACTGT | 27845 | GTG | ACTGCCCAGGGACATAGGCT | 28215 | TTG |
| 314 | ATCCATGTCTGATGTACTGT | 27846 | GTG | AACTGCCCAGGGACATAGGC | 28216 | TTT |
| 315 | AGCGCCATCTTTTCCTGCTG | 27847 | CAAGAAT | | 28217 | |
| 319 | CGTGAGTACTGTCCTCCAGCT | 27848 | ACCAGT | AAGGTCTCCTAGTGCCTCTGA | 28218 | CTCAG |

TABLE 2C-continued

Exemplary left gRNA spacer and right gRNA spacer pairs
Table 2C provides exemplified second-nick gRNA species for optional use for correcting the pathogenic R243Q mutation in PAH. The gRNA spacers from Table 1C were filtered, e.g., filtered by occurrence within 15 nt of the desired editing location and use of a Tier 1 Cas enzyme. Second-nick gRNAs were generated by searching the opposite strand of DNA in the regions −40 to −140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 320 | CCGAACCGTGAGTACTGTCCT | 27849 | CCAG | AGGTCTCCTAGTGCCTCTGAC | 28219 | TCAG |
| 322 | TCCATGTCTGATGTACTGTGT | 27850 | GCAG | ACACATAACTGCCCAGGGACA | 28220 | TAGG |
| 323 | AACCGTGAGTACTGTCCTCC | 27851 | AG | TAAAGGTCTCCTAGTGCCTC | 28221 | TG |
| 327 | ACCGTGAGTACTGTCCTCCA | 27852 | GCT | AAGGTCTCCTAGTGCCTCTG | 28222 | ACT |
| 328 | TCCATGTCTGATGTACTGTG | 27853 | TGC | ACTGCCCAGGGACATAGGCT | 28223 | TTG |
| 329 | AGCGCCATCTTTTCCTGCTG | 27854 | CAAGAAT | | 28224 | |
| 330 | ttggATCCATGTCTGATGTACTG | 27855 | TGTGCAGT | ataaCTGCCCAGGGACATAGGCT | 28225 | TTGAC |
| 331 | ttggATCCATGTCTGATGTACTG | 27856 | TGTGCAGT | ataaCTGCCCAGGGACATAGGCT | 28226 | TTGAC |
| 336 | aaGCCCATGTATACCCCCGAACC | 27857 | GTGAGT | ctAGTGCCTCTGACTCAGTGGTG | 28227 | ATGAG |
| 337 | CGTGAGTACTGTCCTCCAGCT | 27858 | ACCAGT | AAGGTCTCCTAGTGCCTCTGA | 28228 | CTCAG |
| 338 | ATCCATGTCTGATGTACTGTG | 27859 | TGCAGT | TAACTGCCCAGGGACATAGGC | 28229 | TTTGA |
| 341 | GAACCGTGAGTACTGTCCTC | 27860 | CAG | GTCTCCTAGTGCCTCTGACT | 28230 | CAG |
| 342 | CCGTGAGTACTGTCCTCCAG | 27861 | CTA | AGGTCTCCTAGTGCCTCTGA | 28231 | CTC |
| 343 | CCATGTCTGATGTACTGTGT | 27862 | GCA | CTGCCCAGGGACATAGGCTT | 28232 | TGA |
| 350 | CGTGAGTACTGTCCTCCAGCT | 27863 | ACCAGT | AAGGTCTCCTAGTGCCTCTGA | 28233 | CTCAG |
| 351 | GTGAGTACTGTCCTCCAGCTA | 27864 | CCAG | AGGTCTCCTAGTGCCTCTGAC | 28234 | TCAG |
| 353 | AACCGTGAGTACTGTCCTCC | 27865 | AG | TCTCCTAGTGCCTCTGACTC | 28235 | AG |
| 357 | CGTGAGTACTGTCCTCCAGC | 27866 | TAC | GGTCTCCTAGTGCCTCTGAC | 28236 | TCA |
| 358 | CATGTCTGATGTACTGTGTG | 27867 | CAG | TGCCCAGGGACATAGGCTTT | 28237 | GAC |

TABLE 2D

Exemplary left gRNA spacer and right gRNA spacer pairs
Table 2D provides exemplified second-nick gRNA species for optional use for correcting the pathogenic IVS10-11G > A mutation in PAH. The gRNA spacers from Table 1D were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 1 | TCTCTGCCACGTAATAGAGG | 28423 | GGC | TCACCCCGATTCCTTCTACA | 28721 | TCA |
| 2 | GGAGTTCCAGCCCCTCTATTA | 28424 | CGTGG | GCATTTGGGCTGTGATGTAGA | 28722 | AGGAAT |
| 3 | TCTCTGCCACGTAATAGAGG | 28425 | GG | CCCGATTCCTTCTACATCAC | 28723 | AG |
| 6 | GAGTTCCAGCCCCTCTATTA | 28426 | CG | ATTTGGGCTGTGATGTAGAA | 28724 | GG |
| 10 | CTCTGCCACGTAATAGAGGG | 28427 | GCT | CACCCCGATTCCTTCTACAT | 28725 | CAC |
| 12 | GGAGTTCCAGCCCCTCTATT | 28428 | ACG | TTTGGGCTGTGATGTAGAAG | 28726 | GAA |
| 16 | TCTGCCACGTAATAGAGGGG | 28429 | CTG | CCCCGATTCCTTCTACATCA | 28727 | CAG |
| 17 | CTGCCACGTAATAGAGGGGC | 28430 | TGG | CAAATTACTTTGCACATACT | 28728 | AGG |
| 20 | TCTGCCACGTAATAGAGGGG | 28431 | CTG | ACCCCGATTCCTTCTACATC | 28729 | ACA |
| 23 | GGAGTTCCAGCCCCTCTATT | 28432 | ACG | GGGCTGTGATGTAGAAGGAA | 28730 | TCG |
| 24 | GAGTTCCAGCCCCTCTATTA | 28433 | CGT | TTGGGCTGTGATGTAGAAGG | 28731 | AAT |
| 25 | CTGCCACGTAATAGAGGGGC | 28434 | TG | CCCGATTCCTTCTACATCAC | 28732 | AG |
| 28 | ctctGCCACGTAATAGAGGGGCT | 28435 | GGAAC | ctcaCCCCGATTCCTTCTACATC | 28733 | ACAGC |
| 31 | tcTGCCACGTAATAGAGGGGCTGG | 28436 | AACTCC | ctCACCCCGATTCCTTCTACATCA | 28734 | CAGCCC |
| 32 | CTCTGCCACGTAATAGAGGGG | 28437 | CTGG | GCCAAATTACTTTGCACATAC | 28735 | TAGG |
| 33 | CTCTGCCACGTAATAGAGGGG | 28438 | CTGG | CACCCCGATTCCTTCTACATC | 28736 | ACAG |
| 34 | GAGTTCCAGCCCCTCTATTAC | 28439 | GTGG | TGGGCTGTGATGTAGAAGGAA | 28737 | TCGG |
| 39 | CTGCCACGTAATAGAGGGGC | 28440 | TGG | CCCCGATTCCTTCTACATCA | 28738 | CAG |
| 40 | CTGCCACGTAATAGAGGGGC | 28441 | TGG | CAAATTACTTTGCACATACT | 28739 | AGG |
| 43 | CTGCCACGTAATAGAGGGGC | 28442 | TGG | CCCCGATTCCTTCTACATCA | 28740 | CAG |
| 44 | CTGCCACGTAATAGAGGGGC | 28443 | TG | CCCGATTCCTTCTACATCAC | 28741 | AG |

TABLE 2D-continued

Exemplary left gRNA spacer and right gRNA spacer pairs
Table 2D provides exemplified second-nick gRNA species for optional use for correcting the pathogenic IVS10-11G > A mutation in PAH. The gRNA spacers from Table 1D were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 47 | AGTTCCAGCCCCTCTATTAC | 28444 | GTG | TGGGCTGTGATGTAGAAGGA | 28742 | ATC |
| 48 | ctctGCCACGTAATAGAGGGGCT | 28445 | GGAAC | tcacCCCGATTCCTTCTACATCA | 28743 | CAGCCCAA |
| 49 | ctctGCCACGTAATAGAGGGGCT | 28446 | GGAAC | tcacCCCGATTCCTTCTACATCA | 28744 | CAGCCCAA |
| 52 | tcTCTGCCACGTAATAGAGGGGC | 28447 | TGGAA | ttCTACATCACAGCCCAAATGCT | 28745 | GTGAG |
| 53 | TCTGCCACGTAATAGAGGGGC | 28448 | TGGAA | CCGATTCCTTCTACATCACAG | 28746 | CCCAA |
| 54 | GTTCCAGCCCCTCTATTACGT | 28449 | GGCAG | TGGGCTGTGATGTAGAAGGAA | 28747 | TCGGG |
| 55 | GTTCCAGCCCCTCTATTACGT | 28450 | GGCAG | TGGGCTGTGATGTAGAAGGAA | 28748 | TCGGG |
| 58 | CTCTGCCACGTAATAGAGGGG | 28451 | CTGG | GCCAAATTACTTTGCACATAC | 28749 | TAGG |
| 59 | CTCTGCCACGTAATAGAGGGG | 28452 | CTGG | CACCCCGATTCCTTCTACATC | 28750 | ACAG |
| 62 | CTGCCACGTAATAGAGGGGC | 28453 | TGG | CCCCGATTCCTTCTACATCA | 28751 | CAG |
| 63 | TGCCACGTAATAGAGGGGCT | 28454 | GGA | CCCGATTCCTTCTACATCAC | 28752 | AGC |
| 64 | GTTCCAGCCCCTCTATTACG | 28455 | TGG | GGGCTGTGATGTAGAAGGAA | 28753 | TCG |
| 67 | GTTCCAGCCCCTCTATTACGT | 28456 | GGCAG | GGGCTGTGATGTAGAAGGAAT | 28754 | CGGGG |
| 68 | TCTGCCACGTAATAGAGGGGC | 28457 | TGGAA | CCGATTCCTTCTACATCACAG | 28755 | CCCAA |
| 69 | CTCTGCCACGTAATAGAGGGG | 28458 | CTGG | CACCCCGATTCCTTCTACATC | 28756 | ACAG |
| 70 | TTCCAGCCCCTCTATTACGT | 28459 | GGC | GGCTGTGATGTAGAAGGAAT | 28757 | CGG |
| 71 | GCCACGTAATAGAGGGGCTG | 28460 | GAA | CCGATTCCTTCTACATCACA | 28758 | GCC |
| 74 | TCTGCCACGTAATAGAGGGGC | 28461 | TGGAA | CCGATTCCTTCTACATCACAG | 28759 | CCCAA |
| 75 | TCCAGCCCCTCTATTACGTG | 28462 | GCA | GCTGTGATGTAGAAGGAATC | 28760 | GGG |
| 76 | CCACGTAATAGAGGGGCTGG | 28463 | AAC | CGATTCCTTCTACATCACAG | 28761 | CCC |
| 77 | CCAGCCCCTCTATTACGTGG | 28464 | CAG | CTGTGATGTAGAAGGAATCG | 28762 | GGG |
| 78 | CACGTAATAGAGGGGCTGGA | 28465 | ACT | GATTCCTTCTACATCACAGC | 28763 | CCA |
| 79 | CAGCCCCTCTATTACGTG | 28466 | AG | TGTGATGTAGAAGGAATC | 28764 | GG |

TABLE 2D-continued

Exemplary left gRNA spacer and right gRNA spacer pairs
Table 2D provides exemplified second-nick gRNA species for optional use for correcting the pathogenic IVS10-11G > A mutation in PAH. The gRNA spacers from Table 1D were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| | GC | | | GG | | |
| 83 | CAGCCCCTCTATTACGTG GC | 28467 | AGA | TGTGATGTAGAAGGAATC GG | 28765 | GGT |
| 84 | ACGTAATAGAGGGGCTG GAA | 28468 | CTC | ATTCCTTCTACATCACAGC C | 28766 | CAA |
| 85 | cggaGTTCCAGCCCCTCTA TTAC | 28469 | GTGGC | gcatTTGGGCTGTGATGTAG AAG | 28767 | GAATCG GG |
| 86 | cggaGTTCCAGCCCCTCTA TTAC | 28470 | GTGGC | gcatTTGGGCTGTGATGTAG AAG | 28768 | GAATCG GG |
| 87 | cggaGTTCCAGCCCCTCTA TTAC | 28471 | GTGGC | gcatTTGGGCTGTGATGTAG AAG | 28769 | GAATCG GG |
| 90 | taTTACGTGGCAGAGAGTT TTAAT | 28472 | GATGCC | ggTGAGATGAGAGAAGGG GCACAA | 28770 | ATGGCC |
| 93 | AGCCCCTCTATTACGTGG CA | 28473 | GAG | GTGATGTAGAAGGAATCG GG | 28771 | GTG |
| 94 | GTTCCAGCCCCTCTATTA CG | 28474 | TGG | CTGTGATGTAGAAGGAAT CG | 28772 | GGG |
| 97 | AGCCCCTCTATTACGTGG CA | 28475 | GAG | GTGATGTAGAAGGAATCG GG | 28773 | GTG |
| 98 | GCCCCTCTATTACGTGGC AG | 28476 | AG | TGTGATGTAGAAGGAATC GG | 28774 | GG |
| 101 | CGTAATAGAGGGGCTGG AAC | 28477 | TCC | TTCCTTCTACATCACAGCC C | 28775 | AAA |
| 102 | cggaGTTCCAGCCCCTCTA TTAC | 28478 | GTGGCA GA | gcatTTGGGCTGTGATGTAG AAG | 28776 | GAATCG GG |
| 103 | cggaGTTCCAGCCCCTCTA TTAC | 28479 | GTGGCA GA | gcatTTGGGCTGTGATGTAG AAG | 28777 | GAATCG GG |
| 106 | taTTACGTGGCAGAGAGTT TTAAT | 28480 | GATGCC | ggTGAGATGAGAGAAGGG GCACAA | 28778 | ATGGCC |
| 107 | GAGTTCCAGCCCCTCTAT TAC | 28481 | GTGG | GGCTGTGATGTAGAAGGA ATC | 28779 | GGGG |
| 108 | AGCCCCTCTATTACGTGG CAG | 28482 | AGAG | GTGATGTAGAAGGAATCG GGG | 28780 | TGAG |
| 111 | CCCCTCTATTACGTGGCA GA | 28483 | GAG | GTGATGTAGAAGGAATCG GG | 28781 | GTG |
| 112 | GCCCCTCTATTACGTGGC AG | 28484 | AGA | TGATGTAGAAGGAATCGG GG | 28782 | TGA |
| 113 | GTAATAGAGGGGCTGGA ACT | 28485 | CCG | TCCTTCTACATCACAGCCC A | 28783 | AAT |
| 114 | cgtaATAGAGGGGCTGGAA CTCC | 28486 | GTGAC | gattCCTTCTACATCACAGCC CA | 28784 | AATGCT GT |

TABLE 2D-continued

Exemplary left gRNA spacer and right gRNA spacer pairs
Table 2D provides exemplified second-nick gRNA species for optional use for correcting the pathogenic IVS10-11G > A mutation in PAH. The gRNA spacers from Table 1D were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 115 | cggaGTTCCAGCCCCTCTATTAC | 28487 | GTGGCAGA | gcatTTGGGCTGTGATGTAGAAG | 28785 | GAATCGGG |
| 116 | cgtaATAGAGGGGCTGGAACTCC | 28488 | GTGAC | gattCCTTCTACATCACAGCCCA | 28786 | AATGCTGT |
| 119 | CAGCCCCTCTATTACGTGGCA | 28489 | GAGAGT | GTGATGTAGAAGGAATCGGGG | 28787 | TGAGAT |
| 120 | AGCCCCTCTATTACGTGGCAG | 28490 | AGAG | GTGATGTAGAAGGAATCGGGG | 28788 | TGAG |
| 121 | CCCCTCTATTACGTGGCAGA | 28491 | GAG | GATGTAGAAGGAATCGGGGT | 28789 | GAG |
| 122 | TAATAGAGGGGCTGGAACTC | 28492 | CGT | CCTTCTACATCACAGCCCAA | 28790 | ATG |
| 125 | CTCTATTACGTGGCAGAGAGT | 28493 | TTTAA | ATGTAGAAGGAATCGGGGTGA | 28791 | GATGA |
| 126 | CCCTCTATTACGTGGCAGAG | 28494 | AG | ATGTAGAAGGAATCGGGGTG | 28792 | AG |
| 130 | CCCTCTATTACGTGGCAGAG | 28495 | AGT | ATGTAGAAGGAATCGGGGTG | 28793 | AGA |
| 131 | AATAGAGGGGCTGGAACTCC | 28496 | GTG | CTTCTACATCACAGCCCAAA | 28794 | TGC |
| 132 | cgtaATAGAGGGGCTGGAACTCC | 28497 | GTGAC | gattCCTTCTACATCACAGCCCA | 28795 | AATGCTGT |
| 136 | CCCCTCTATTACGTGGCAGA | 28498 | GAG | GTAGAAGGAATCGGGGTGAG | 28796 | ATG |
| 137 | CCTCTATTACGTGGCAGAGA | 28499 | GTT | TGTAGAAGGAATCGGGGTGA | 28797 | GAT |
| 138 | ATAGAGGGGCTGGAACTCCG | 28500 | TGA | TTCTACATCACAGCCCAAAT | 28798 | GCT |
| 139 | CTCTATTACGTGGCAGAGAG | 28501 | TTT | GTAGAAGGAATCGGGGTGAG | 28799 | ATG |
| 140 | TAGAGGGGCTGGAACTCCGT | 28502 | GAC | TCTACATCACAGCCCAAATG | 28800 | CTG |
| 141 | TCTATTACGTGGCAGAGAGT | 28503 | TTT | TAGAAGGAATCGGGGTGAGA | 28801 | TGA |
| 142 | AGAGGGGCTGGAACTCCGTG | 28504 | ACA | CTACATCACAGCCCAAATGC | 28802 | TGT |
| 145 | GAGGGGCTGGAACTCCGTGA | 28505 | CAG | TACATCACAGCCCAAATGCT | 28803 | GTG |
| 146 | CTATTACGTGGCAGAGAGTT | 28506 | TTA | AGAAGGAATCGGGGTGAGAT | 28804 | GAG |
| 150 | TACGTGGCAGAGAGTTTTAA | 28507 | TG | GAAGGAATCGGGGTGAGATG | 28805 | AG |
| 154 | TATTACGTGGCAGAGAGTTT | 28508 | TAA | GAAGGAATCGGGGTGAGATG | 28806 | AGA |

TABLE 2D-continued

Exemplary left gRNA spacer and right gRNA spacer pairs
Table 2D provides exemplified second-nick gRNA species for optional use for correcting the pathogenic IVS10-11G > A mutation in PAH. The gRNA spacers from Table 1D were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 155 | AGGGGCTGGAACTCCGTGAC | 28509 | AGT | ACATCACAGCCCAAATGCTG | 28807 | TGA |
| 156 | attaCGTGGCAGAGAGTTTTAAT | 28510 | GATGCCAA | ggaaTCGGGGTGAGATGAGAGAA | 28808 | GGGGC |
| 157 | cgtaATAGAGGGGCTGGAACTCC | 28511 | GTGAC | tctaCATCACAGCCCAAATGCTG | 28809 | TGAGCCAA |
| 158 | attaCGTGGCAGAGAGTTTTAAT | 28512 | GATGCCAA | ggaaTCGGGGTGAGATGAGAGAA | 28810 | GGGGC |
| 159 | cgtaATAGAGGGGCTGGAACTCC | 28513 | GTGAC | tctaCATCACAGCCCAAATGCTG | 28811 | TGAGCCAA |
| 164 | GGGGCTGGAACTCCGTGACAG | 28514 | TGTAA | ATCACAGCCCAAATGCTGTGA | 28812 | GCCAA |
| 167 | TTACGTGGCAGAGAGTTTTA | 28515 | ATG | AAGGAATCGGGGTGAGATGA | 28813 | GAG |
| 168 | ATTACGTGGCAGAGAGTTTT | 28516 | AAT | AAGGAATCGGGGTGAGATGA | 28814 | GAG |
| 169 | GGGGCTGGAACTCCGTGACA | 28517 | GTG | CATCACAGCCCAAATGCTGT | 28815 | GAG |
| 173 | GGCAGAGAGTTTTAATGATGC | 28518 | CAAG | AGGAATCGGGGTGAGATGAGA | 28816 | GAAG |
| 174 | GGGCTGGAACTCCGTGACAG | 28519 | TGT | ATCACAGCCCAAATGCTGTG | 28817 | AGC |
| 175 | TTACGTGGCAGAGAGTTTTA | 28520 | ATG | AGGAATCGGGGTGAGATGAG | 28818 | AGA |
| 179 | TATTACGTGGCAGAGAGTTTT | 28521 | AATGA | AGGAATCGGGGTGAGATGAGA | 28819 | GAAGG |
| 180 | TATTACGTGGCAGAGAGTTTT | 28522 | AATGA | AGGAATCGGGGTGAGATGAGA | 28820 | GAAGG |
| 183 | TACGTGGCAGAGAGTTTTAA | 28523 | TG | AGGAATCGGGGTGAGATGAG | 28821 | AG |
| 187 | TACGTGGCAGAGAGTTTTAA | 28524 | TGA | GGAATCGGGGTGAGATGAGA | 28822 | GAA |
| 188 | GGCTGGAACTCCGTGACAGT | 28525 | GTA | TCACAGCCCAAATGCTGTGA | 28823 | GCC |
| 191 | GGGGCTGGAACTCCGTGACAG | 28526 | TGTAA | TCACAGCCCAAATGCTGTGAG | 28824 | CCAAA |
| 192 | GGGGCTGGAACTCCGTGACAG | 28527 | TGTAA | TCACAGCCCAAATGCTGTGAG | 28825 | CCAAA |
| 195 | CGTGGCAGAGAGTTTTAATG | 28528 | ATG | GAATCGGGGTGAGATGAGAG | 28826 | AAG |
| 196 | ACGTGGCAGAGAGTTTTAAT | 28529 | GAT | GAATCGGGGTGAGATGAGAG | 28827 | AAG |
| 197 | GCTGGAACTCCGTGACAGTG | 28530 | TAA | CACAGCCCAAATGCTGTGAG | 28828 | CCA |

TABLE 2D-continued

Exemplary left gRNA spacer and right gRNA spacer pairs
Table 2D provides exemplified second-nick gRNA species for optional use for correcting the pathogenic IVS10-11G > A mutation in PAH. The gRNA spacers from Table 1D were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 201 | GGCAGAGAGTTTTAATGATGC | 28531 | CAAG | GAATCGGGGTGAGATGAGAGA | 28829 | AGGG |
| 204 | GGGCTGGAACTCCGTGACAG | 28532 | TG | ATCACAGCCCAAATGCTGTG | 28830 | AG |
| 207 | CGTGGCAGAGAGTTTTAATG | 28533 | ATG | AATCGGGGTGAGATGAGAGA | 28831 | AGG |
| 209 | CTGGAACTCCGTGACAGTGT | 28534 | AAT | ACAGCCCAAATGCTGTGAGC | 28832 | CAA |
| 210 | ttacGTGGCAGAGAGTTTTAATG | 28535 | ATGCCAAG | ggaaTCGGGGTGAGATGAGAGAA | 28833 | GGGGC |
| 211 | ttacGTGGCAGAGAGTTTTAATG | 28536 | ATGCCAAG | ggaaTCGGGGTGAGATGAGAGAA | 28834 | GGGGC |
| 215 | GTGGCAGAGAGTTTTAATGAT | 28537 | GCCAA | GAATCGGGGTGAGATGAGAGA | 28835 | AGGGG |
| 218 | AACTCCGTGACAGTGTAATT | 28538 | TTG | CATCACAGCCCAAATGCTGT | 28836 | GAG |
| 219 | TGGAACTCCGTGACAGTGTA | 28539 | ATT | CAGCCCAAATGCTGTGAGCC | 28837 | AAA |
| 220 | GTGGCAGAGAGTTTTAATGA | 28540 | TGC | ATCGGGGTGAGATGAGAGAA | 28838 | GGG |
| 223 | GTGGCAGAGAGTTTTAATGAT | 28541 | GCCAA | GAATCGGGGTGAGATGAGAGA | 28839 | AGGGG |
| 224 | GGAACTCCGTGACAGTGTAAT | 28542 | TTTGG | TCACAGCCCAAATGCTGTGAG | 28840 | CCAAAT |
| 225 | GGAACTCCGTGACAGTGTAAT | 28543 | TTTGG | TCACAGCCCAAATGCTGTGAG | 28841 | CCAAAT |
| 226 | ACTCCGTGACAGTGTAATTT | 28544 | TG | ATCACAGCCCAAATGCTGTG | 28842 | AG |
| 229 | TGGCAGAGAGTTTTAATGAT | 28545 | GCC | TCGGGGTGAGATGAGAGAAG | 28843 | GGG |
| 232 | GGAACTCCGTGACAGTGTAA | 28546 | TTT | AGCCCAAATGCTGTGAGCCA | 28844 | AAT |
| 236 | AACTCCGTGACAGTGTAATT | 28547 | TTG | ATGCTGTGAGCCAAATTACT | 28845 | TTG |
| 237 | GAACTCCGTGACAGTGTAAT | 28548 | TTT | GCCCAAATGCTGTGAGCCAA | 28846 | ATT |
| 238 | GTGGCAGAGAGTTTTAATGA | 28549 | TG | CGGGGTGAGATGAGAGAAGG | 28847 | GG |
| 242 | GGCAGAGAGTTTTAATGATG | 28550 | CCA | CGGGGTGAGATGAGAGAAGG | 28848 | GGC |
| 247 | GAACTCCGTGACAGTGTAATT | 28551 | TTGG | TACATCACAGCCCAAATGCTG | 28849 | TGAG |
| 250 | CAGAGAGTTTTAATGATGCC | 28552 | AAG | TCGGGGTGAGATGAGAGAAG | 28850 | GGG |

TABLE 2D-continued

Exemplary left gRNA spacer and right gRNA spacer pairs
Table 2D provides exemplified second-nick gRNA species for optional use for correcting the pathogenic IVS10-11G > A mutation in PAH. The gRNA spacers from Table 1D were filtered, e.g., filtered by occurrence within 15 nt of the desired editing location and use of a Tier 1 Cas enzyme. Second-nick gRNAs were generated by searching the opposite strand of DNA in the regions -40 to -140 ("left") and +40 to +140 ("right"), relative to the first nick site defined by the first gRNA, for the PAM utilized by the corresponding Cas variant. One exemplary spacer is shown for each side of the target nick site.

| ID | Left gRNA spacer | SEQ ID NO | Left PAM | Right gRNA spacer | SEQ ID NO | Right PAM |
|---|---|---|---|---|---|---|
| 251 | GCAGAGAGTTTTAATGATGC | 28553 | CAA | GGGGTGAGATGAGAGAAGGG | 28851 | GCA |
| 252 | AACTCCGTGACAGTGTAATT | 28554 | TTG | CCCAAATGCTGTGAGCCAAA | 28852 | TTA |
| 255 | GCAGAGAGTTTTAATGATGCC | 28555 | AAGGA | GGGGTGAGATGAGAGAAGGGG | 28853 | CACAA |
| 256 | GAACTCCGTGACAGTGTAATT | 28556 | TTGGA | TCACAGCCCAAATGCTGTGAG | 28854 | CCAAAT |
| 257 | GCAGAGAGTTTTAATGATGCC | 28557 | AAGGA | GGGGTGAGATGAGAGAAGGGG | 28855 | CACAA |
| 258 | GAACTCCGTGACAGTGTAATT | 28558 | TTGGA | TCACAGCCCAAATGCTGTGAG | 28856 | CCAAAT |
| 261 | ACTCCGTGACAGTGTAATTT | 28559 | TGG | CCAAATGCTGTGAGCCAAAT | 28857 | TAC |
| 262 | CAGAGAGTTTTAATGATGCC | 28560 | AAG | GGGTGAGATGAGAGAAGGGG | 28858 | CAC |
| 264 | CTCCGTGACAGTGTAATTTT | 28561 | GGA | CAAATGCTGTGAGCCAAATT | 28859 | ACT |
| 265 | AGAGAGTTTTAATGATGCCA | 28562 | AGG | GGTGAGATGAGAGAAGGGGC | 28860 | ACA |
| 269 | GAGAGTTTTAATGATGCCAA | 28563 | GGA | GTGAGATGAGAGAAGGGGCA | 28861 | CAA |
| 270 | TCCGTGACAGTGTAATTTTG | 28564 | GAT | AAATGCTGTGAGCCAAATTA | 28862 | CTT |
| 271 | actcCGTGACAGTGTAATTTTGG | 28565 | ATGGC | ccaaATGCTGTGAGCCAAATTAC | 28863 | TTTGC |
| 272 | actcCGTGACAGTGTAATTTTGG | 28566 | ATGGC | ccaaATGCTGTGAGCCAAATTAC | 28864 | TTTGC |
| 273 | CTCCGTGACAGTGTAATTTTG | 28567 | GATGG | TCACAGCCCAAATGCTGTGAG | 28865 | CCAAAT |
| 274 | AGAGTTTTAATGATGCCAAG | 28568 | GAG | TGAGATGAGAGAAGGGGCAC | 28866 | AAA |
| 275 | CCGTGACAGTGTAATTTTGG | 28569 | ATG | AATGCTGTGAGCCAAATTAC | 28867 | TTT |
| 276 | ttacGTGGCAGAGAGTTTTAATG | 28570 | ATGCCAAG | gtgaGATGAGAGAAGGGGCACAA | 28868 | ATGGCCTA |
| 277 | ttacGTGGCAGAGAGTTTTAATG | 28571 | ATGCCAAG | gtgaGATGAGAGAAGGGGCACAA | 28869 | ATGGCCTA |

Capital letters indicate "core nucleotides" while lower case letters indicate "flanking nucleotides." Herein, when an RNA sequence (e.g., a gRNA to produce a second nick) is said to comprise a particular sequence (e.g., a sequence of Table 2A, Table 2B, Table 2C, or Table 2D or a portion thereof) that comprises thymine (T), it is of course understood that the RNA sequence may (and frequently does) comprise uracil (U) in place of T. For instance, the RNA sequence may comprise U at every position shown as T in the sequence in Table 2A, Table 2B, Table 2C, or Table 2D. More specifically, the present disclosure provides an RNA sequence according to every gRNA spacer sequence shown in Table 2A, Table 2B, Table 2C, or Table 2D, wherein the RNA sequence has a U in place of each T in the sequence in Table 2A, Table 2B, Table 2C, or Table 2D.

In some embodiments, the systems and methods provided herein may comprise a template sequence listed in Table 4A, Table 4B, Table 4C, or Table 4D. Table 4A, Table 4B, Table 4C, or Table 4D provides exemplary template RNA sequences (column 4) and optional second-nick gRNA spacer sequences (column 5) designed to be paired with a gene modifying polypeptide to correct a mutation in the PAH gene. The templates in Table 4A, Table 4B, Table 4C, or Table 4D are meant to exemplify the total sequence of: (1) gRNA spacer (e.g., for targeting for first strand nick), (2) gRNA scaffold, (3) heterologous object sequence, and (4) PBS sequence (e.g., for initiating TPRT at first strand nick).

TABLE 4A

Exemplary template RNA sequences and second nick gRNA spacer sequences

Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 1 | SpyCas9-SpRY | - | TTGCTGCCACAATACCTTGGGTTTTAGAGCTAGAAATAGCAAGTTAAAATAAGGCTAGTCCGTTATCAACTTGAAAAAGTGGCACCGAGTCGGTGCgtatgggtcgtagcgaactgagaagggcCGAGGTATTGtggc | 29019 | CTCGTAAGGTGTAAATTACTGTTTTAGAGCTAGAAATAGCAAGTTAAAATAAGGCTAGTCCGTTATCAACTTGAAAAAGTGGCACCGAGTCGGTGC | 29209 |
| 2 | SpyCas9-NG | + | AGCGAACTGAGAAGGGCCAAGTTTTAGAGCTAGAAATAGCAAGTTAAAATAAGGCTAGTCCGTTATCAACTTGAAAAAGTGGCACCGAGTCGGTGCtcttaggaactttgctgccacaataccTCGGCCCTTCTcagt | 29020 | TTCCTAAAAAAGAAGTAAAAGTTTTAGAGCTAGAAATAGCAAGTTAAAATAAGGCTAGTCCGTTATCAACTTGAAAAAGTGGCACCGAGTCGGTGC | 29210 |
| 6 | SpyCas9-SpRY | + | AGCGAACTGAGAAGGGCCAAGTTTTAGAGCTAGAAATAGCAAGTTAAAATAAGGCTAGTCCGTTATCAACTTGAAAAAGTGGCACCGAGTCGGTGCtcttaggaactttgctgccacaataccTCGGCCCTTCTcagt | 29021 | CCTAAAAAAGAAGTAAAATGGTTTTAGAGCTAGAAATAGCAAGTTAAAATAAGGCTAGTCCGTTATCAACTTGAAAAAGTGGCACCGAGTCGGTGC | 29211 |
| 7 | SpyCas9-SpRY | - | TTTGCTGCCACAATACCTTGGTTTTAGAGCTAGAAATAGCAAGTTAAAATAAGGCTAGTCCGTTATCAACTTGAAAAAGTGGCACCGAGTCGGTGCtatgggtcgtagcgaactgagaagggcCGAGGTATTGTggca | 29022 | TCGTAAGGTGTAAATTACTTGTTTTAGAGCTAGAAATAGCAAGTTAAAATAAGGCTAGTCCGTTATCAACTTGAAAAAGTGGCACCGAGTCGGTGC | 29212 |
| 10 | PpnCas9 | + | gtcGTAGCGAACTGAGAAGGGCCAGTTGTAGCTCCCTTTTTCATTTCGCGAAAGCGAAATGAAAAACGTTGTTACAATAAGAGATGAATTTCTCGCAAAGCTCTGCCTCTTGAAATTTCGGTTTCAAGAGGCATCCttaggaactttgctgccacaataccTCGGCCCTTCTCagtt | 29023 | gaaGACCCTGCTCTAGGGAGGTGTGTTGTAGCTCCCTTTTTCATTTCGCGAAAGCGAAATGAAAAACGTTGTTACAATAAGAGATGAATTTCTCGCAAAGCTCTGCCTCTTGAAATTTCGGTTTCAAGAGGCATC | 29213 |
| 13 | ScaCas9-Sc++ | + | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCcttaggaactttgctgccacaataccTCGGCCCTTCTCagtt | 29024 | AAAAAAGAAGTAAAATGCCAGTTTTAGAGCTAGAAATAGCAAGTTAAAATAAGGCTAGTCCGTTATCAACTTGAAAAAGTGGCACCGAGTCGGTGC | 29214 |
| 14 | SpyCas9 | + | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCcttaggaactttgctgccacaataccTCGGCCCTTCTCagtt | 29025 | TTGAAGACCCTGCTCTAGGGGGTTTTAGAGCTAGAAATAGCAAGTTAAAATAAGGCTAGTCCGTTATCAACTTGAAAAAGTGGCACCGAGTCGGTGC | 29215 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 17 | SpyCas9-SpRY | + | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCcttaggaactttgctgccacaataccTCGGCCCTTCTCagtt | 29026 | CTAAAAAAGAAGTAAAATGCGTTTTAGAGCTAGAAATAGCAAGTTAAAATAAGGCTAGTCCGTTATCAACTTGAAAAAGTGGCACCGAGTCGGTGC | 29216 |
| 18 | SpyCas9-NG | - | CTTTGCTGCCACAATACCTTGTTTTAGAGCTAGAAATAGCAAGTTAAAATAAGGCTAGTCCGTTATCAACTTGAAAAAGTGGCACCGAGTCGGTGCatgggtcgtagcgaactgagaagggcCGAGGTATTGTGgcag | 29027 | GTAAGGTGTAAATTACTTACGTTTTAGAGCTAGAAATAGCAAGTTAAAATAAGGCTAGTCCGTTATCAACTTGAAAAAGTGGCACCGAGTCGGTGC | 29217 |
| 21 | SpyCas9-NG | + | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCcttaggaactttgctgccacaataccTCGGCCCTTCTCagtt | 29028 | AAAAAGAAGTAAAATGCCACGTTTTAGAGCTAGAAATAGCAAGTTAAAATAAGGCTAGTCCGTTATCAACTTGAAAAAGTGGCACCGAGTCGGTGC | 29218 |
| 25 | SpyCas9-SpRY | - | CTTTGCTGCCACAATACCTTGTTTTAGAGCTAGAAATAGCAAGTTAAAATAAGGCTAGTCCGTTATCAACTTGAAAAAGTGGCACCGAGTCGGTGCatgggtcgtagcgaactgagaagggcCGAGGTATTGTGgcag | 29029 | CGTAAGGTGTAAATTACTTAGTTTTAGAGCTAGAAATAGCAAGTTAAAATAAGGCTAGTCCGTTATCAACTTGAAAAAGTGGCACCGAGTCGGTGC | 29219 |
| 26 | BlatCas9 | - | gaacTTTGCTGCCACAATACCTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTatgggtcgtagcgaactgagaagggcCGAGGTATTGTGgcag | 29030 | gtggCCTCGTAAGGTGTAAATTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29220 |
| 29 | Nme2Cas9 | - | agGAACTTTGCTGCCACAATACCTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAtgggtcgtagcgaactgagaagggcCGAGGTATTGTGGcagc | 29031 | gtAAATTACTTACTGTTAATGGAAGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29221 |
| 30 | SauriCas9 | + | CGTAGCGAACTGAGAAGGGCCGTTTTAGTACTCTGGAAACAGAATCTACTAAAACAAGGCAAAATGCCGTGTTTATCTCGTCAACTTGTTGGCGAGAttaggaactttgctgccacaataccTCGGCCCTTCTCAgttc | 29032 | CTTAAGACTACCTTTCTCCAAGTTTTAGTACTCTGGAAACAGAATCTACTAAAACAAGGCAAAATGCCGTGTTTATCTCGTCAACTTGTTGGCGAGA | 29222 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 31 | SauriCas9-KKH | + | CGTAGCGAACTGAGAAGGGCCGTTTTAGTACTCTGGAAACAGAATCTACTAAAACAAGGCAAAATGCCGTGTTTATCTCGTCAACTTGTTGGCGAGAttaggaactttgctgccacaataccTCGGCCCTTCTCAgttc | 29033 | AAAAAGAAGTAAAATGCCACGTTTTAGTACTCTGGAAACAGAATCTACTAAAACAAGGCAAAATGCCGTGTTTATCTCGTCAACTTGTTGGCGAGA | 29223 |
| 34 | ScaCas9-Sc++ | − | ACTTTGCTGCCACAATACCTGTTTTAGAGCTAGAAATAGCAAGTTAAAATAAGGCTAGTCCGTTATCAACTTGAAAAAGTGGCACCGAGTCGGTGCtgggtcgtagcgaactgagaagggcCGAGGTATTGTGGcagc | 29034 | CGTAAGGTGTAAATTACTTAGTTTTAGAGCTAGAAATAGCAAGTTAAAATAAGGCTAGTCCGTTATCAACTTGAAAAAGTGGCACCGAGTCGGTGC | 29224 |
| 35 | SpyCas9 | − | ACTTTGCTGCCACAATACCTGTTTTAGAGCTAGAAATAGCAAGTTAAAATAAGGCTAGTCCGTTATCAACTTGAAAAAGTGGCACCGAGTCGGTGCtgggtcgtagcgaactgagaagggcCGAGGTATTGTGGcagc | 29035 | TGTAAATTACTTACTGTTAAGTTTTAGAGCTAGAAATAGCAAGTTAAAATAAGGCTAGTCCGTTATCAACTTGAAAAAGTGGCACCGAGTCGGTGC | 29225 |
| 38 | SpyCas9-SpRY | − | ACTTTGCTGCCACAATACCTGTTTTAGAGCTAGAAATAGCAAGTTAAAATAAGGCTAGTCCGTTATCAACTTGAAAAAGTGGCACCGAGTCGGTGCtgggtcgtagcgaactgagaagggcCGAGGTATTGTGGcagc | 29036 | GTAAGGTGTAAATTACTTACGTTTTAGAGCTAGAAATAGCAAGTTAAAATAAGGCTAGTCCGTTATCAACTTGAAAAAGTGGCACCGAGTCGGTGC | 29226 |
| 41 | ScaCas9-Sc++ | + | GTAGCGAACTGAGAAGGGCCGTTTTAGAGCTAGAAATAGCAAGTTAAAATAAGGCTAGTCCGTTATCAACTTGAAAAAGTGGCACCGAGTCGGTGCttaggaactttgctgccacaataccTCGGCCCTTCTCAgttc | 29037 | AAAAAAGAAGTAAAATGCCAGTTTTAGAGCTAGAAATAGCAAGTTAAAATAAGGCTAGTCCGTTATCAACTTGAAAAAGTGGCACCGAGTCGGTGC | 29227 |
| 42 | SpyCas9-SpRY | + | GTAGCGAACTGAGAAGGGCCGTTTTAGAGCTAGAAATAGCAAGTTAAAATAAGGCTAGTCCGTTATCAACTTGAAAAAGTGGCACCGAGTCGGTGCttaggaactttgctgccacaataccTCGGCCCTTCTCAgttc | 29038 | TAAAAAAGAAGTAAAATGCCGTTTTAGAGCTAGAAATAGCAAGTTAAAATAAGGCTAGTCCGTTATCAACTTGAAAAAGTGGCACCGAGTCGGTGC | 29228 |
| 43 | SpyCas9-NG | − | ACTTTGCTGCCACAATACCTGTTTTAGAGCTAGAAATAGCAAGTTAAAATAAGGCTAGTCCGTTATCAACTTGAAAAAGTGGCACCGAGTCGGTGCtgggtcgtagcgaactgagaagggcCGAGGTATTGTGGcagc | 29039 | GTAAGGTGTAAATTACTTACGTTTTAGAGCTAGAAATAGCAAGTTAAAATAAGGCTAGTCCGTTATCAACTTGAAAAAGTGGCACCGAGTCGGTGC | 29229 |
| 46 | BlatCas9 | − | ggaaCTTTGCTGCCACAATACCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTgggtcgtagcgaactgagaagggcCGAGGTATTGTGGcagc | 29040 | gtggCCTCGTAAGGTGTAAATTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29230 |

TABLE 4A-continued

Exemplary template RNA sequences and second nick gRNA spacer sequences

Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 47 | BlatCas9 | - | ggaaCTTTGCTGCCACAATACCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTgggtcgtagcgaactgagaagggcCGAGGTATTGTGGcagc | 29041 | gtggCCTCGTAAGGTGTAAATTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29231 |
| 50 | Nme2Cas9 | - | taGGAACTTTGCTGCCACAATACCGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAgggtcgtagcgaactgagaagggcCGAGGTATTGTGGCagca | 29042 | gtAAATTACTTACTGTTAATGGAAGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29232 |
| 51 | SauCas9KKH | + | TCGTAGCGAACTGAGAAGGGCGTTTTAGTACTCTGGAAACAGAATCTACTAAAACAAGGCAAAATGCCGTGTTTATCTCGTCAACTTGTTGGCGAGAtaggaactttgctgccacaataccTCGGCCCTTCTCAGttcg | 29043 | TAAAAAAGAAGTAAAATGCCAGTTTTAGTACTCTGGAAACAGAATCTACTAAAACAAGGCAAAATGCCGTGTTTATCTCGTCAACTTGTTGGCGAGA | 29233 |
| 52 | SauCas9KKH | + | TCGTAGCGAACTGAGAAGGGCGTTTTAGTACTCTGGAAACAGAATCTACTAAAACAAGGCAAAATGCCGTGTTTATCTCGTCAACTTGTTGGCGAGAtaggaactttgctgccacaataccTCGGCCCTTCTCAGttcg | 29044 | TAAAAAAGAAGTAAAATGCCAGTTTTAGTACTCTGGAAACAGAATCTACTAAAACAAGGCAAAATGCCGTGTTTATCTCGTCAACTTGTTGGCGAGA | 29234 |
| 55 | SauriCas9 | - | GAACTTTGCTGCCACAATACCGTTTTAGTACTCTGGAAACAGAATCTACTAAAACAAGGCAAAATGCCGTGTTTATCTCGTCAACTTGTTGGCGAGAgggtcgtagcgaactgagaagggcCGAGGTATTGTGGCagca | 29045 | GGTGTAAATTACTTACTGTTAGTTTTAGTACTCTGGAAACAGAATCTACTAAAACAAGGCAAAATGCCGTGTTTATCTCGTCAACTTGTTGGCGAGA | 29235 |
| 56 | SauriCas9-KKH | - | GAACTTTGCTGCCACAATACCGTTTTAGTACTCTGGAAACAGAATCTACTAAAACAAGGCAAAATGCCGTGTTTATCTCGTCAACTTGTTGGCGAGAgggtcgtagcgaactgagaagggcCGAGGTATTGTGGCagca | 29046 | GGTGTAAATTACTTACTGTTAGTTTTAGTACTCTGGAAACAGAATCTACTAAAACAAGGCAAAATGCCGTGTTTATCTCGTCAACTTGTTGGCGAGA | 29236 |
| 57 | SauriCas9-KKH | + | TCGTAGCGAACTGAGAAGGGCGTTTTAGTACTCTGGAAACAGAATCTACTAAAACAAGGCAAAATGCCGTGTTTATCTCGTCAACTTGTTGGCGAGAtaggaactttgctgccacaataccTCGGCCCTTCTCAGttcg | 29047 | AAAAAAGAAGTAAAATGCCACGTTTTAGTACTCTGGAAACAGAATCTACTAAAACAAGGCAAAATGCCGTGTTTATCTCGTCAACTTGTTGGCGAGA | 29237 |
| 62 | ScaCas9-Sc++ | - | AACTTTGCTGCCACAATACCGTTTTAGAGCTAGAAATAGCAAGTTAAAATAAGGCTAGTCCGTTATCAACTTGAAAAAG | 29048 | CGTAAGGTGTAAATTACTTAGTTTTAGAGCTAGAAATAGCAAGTTAAAATAAGGCTA | 29238 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | TGGCACCGAGTCGGTGCgggtcgtagcgaactgagaagggcCGAGGTATTGTGGCagca | | GTCCGTTATCAACTTGAAAAAGTGGCACCGAGTCGGTGC | |
| 63 | SpyCas9-SpRY | - | AACTTTGCTGCCACAATACCGTTTTAGAGCTAGAAATAGCAAGTTAAAATAAGGCTAGTCCGTTATCAACTTGAAAAAGTGGCACCGAGTCGGTGCgggtcgtagcgaactgagaagggcCGAGGTATTGTGGCagca | 29049 | TAAGGTGTAAATTACTTACTGTTTTAGAGCTAGAAATAGCAAGTTAAAATAAGGCTAGTCCGTTATCAACTTGAAAAAGTGGCACCGAGTCGGTGC | 29239 |
| 64 | SpyCas9-SpRY | + | CGTAGCGAACTGAGAAGGGCGTTTTAGAGCTAGAAATAGCAAGTTAAAATAAGGCTAGTCCGTTATCAACTTGAAAAAGTGGCACCGAGTCGGTGCtaggaactttgctgccacaataccTCGGCCCTTCTCAGttcg | 29050 | AAAAAAGAAGTAAAATGCCAGTTTTAGAGCTAGAAATAGCAAGTTAAAATAAGGCTAGTCCGTTATCAACTTGAAAAAGTGGCACCGAGTCGGTGC | 29240 |
| 65 | BlatCas9 | - | aggaACTTTGCTGCCACAATACCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTgggtcgtagcgaactgagaagggcCGAGGTATTGTGGCagca | 29051 | gtggCCTCGTAAGGTGTAAATTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29241 |
| 66 | SauCas9KKH | + | GTCGTAGCGAACTGAGAAGGGGTTTTAGTACTCTGGAAACAGAATCTACTAAAACAAGGCAAAATGCCGTGTTTATCTCGTCAACTTGTTGGCGAGAaggaactttgctgccacaataccTCGGCCCTTCTCAGTtcgc | 29052 | AAAAAAGAAGTAAAATGCCACGTTTTAGTACTCTGGAAACAGAATCTACTAAAACAAGGCAAAATGCCGTGTTTATCTCGTCAACTTGTTGGCGAGA | 29242 |
| 67 | SauCas9KKH | - | GGAACTTTGCTGCCACAATACGTTTTAGTACTCTGGAAACAGAATCTACTAAAACAAGGCAAAATGCCGTGTTTATCTCGTCAACTTGTTGGCGAGAggtcgtagcgaactgagaagggcCGAGGTATTGTGGCAgcaa | 29053 | GTAAGGTGTAAATTACTTACTGTTTTAGTACTCTGGAAACAGAATCTACTAAAACAAGGCAAAATGCCGTGTTTATCTCGTCAACTTGTTGGCGAGA | 29243 |
| 68 | SpyCas9-SpRY | + | TCGTAGCGAACTGAGAAGGGGTTTTAGAGCTAGAAATAGCAAGTTAAAATAAGGCTAGTCCGTTATCAACTTGAAAAAGTGGCACCGAGTCGGTGCaggaactttgctgccacaataccTCGGCCCTTCTCAGTtcgc | 29054 | AAAAAGAAGTAAAATGCCACGTTTTAGAGCTAGAAATAGCAAGTTAAAATAAGGCTAGTCCGTTATCAACTTGAAAAAGTGGCACCGAGTCGGTGC | 29244 |
| 69 | SpyCas9-SpRY | - | GAACTTTGCTGCCACAATACGTTTTAGAGCTAGAAATAGCAAGTTAAAATAAGGCTAGTCCGTTATCAACTTGAAAAAGTGGCACCGAGTCGGTGCggtcgtagcgaactgagaagggcCGAGGTATTGTGGCAgcaa | 29055 | AAGGTGTAAATTACTTACTGGTTTTAGAGCTAGAAATAGCAAGTTAAAATAAGGCTAGTCCGTTATCAACTTGAAAAAGTGGCACCGAGTCGGTGC | 29245 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 72 | SauCas9KKH | + | GGTCGTAGCGAACTGAGAAGGGTTTTAGTACTCTGGAAACAGAATCTACTAAAACAAGGCAAAATGCCGTGTTTATCTCGTCAACTTGTTGGCGAGAggaactttgctgccacaataccTCGGCCCTTCTCAGTTcgct | 29056 | AAAAGAAGTAAAATGCCACTGTTTTAGTACTCTGGAAACAGAATCTACTAAAACAAGGCAAAATGCCGTGTTTATCTCGTCAACTTGTTGGCGAGA | 29246 |
| 73 | SpyCas9-SpRY | + | GTCGTAGCGAACTGAGAAGGGTTTTAGAGCTAGAAATAGCAAGTTAAAATAAGGCTAGTCCGTTATCAACTTGAAAAAGTGGCACCGAGTCGGTGCggaactttgctgccacaataccTCGGCCCTTCTCAGTTcgct | 29057 | AAAAGAAGTAAAATGCCACTGTTTTAGAGCTAGAAATAGCAAGTTAAAATAAGGCTAGTCCGTTATCAACTTGAAAAAGTGGCACCGAGTCGGTGC | 29247 |
| 74 | SpyCas9-SpRY | − | GGAACTTTGCTGCCACAATAGTTTTAGAGCTAGAAATAGCAAGTTAAAATAAGGCTAGTCCGTTATCAACTTGAAAAAGTGGCACCGAGTCGGTGCgtcgtagcgaactgagaagggcCGAGGTATTGTGGCAGcaaa | 29058 | AGGTGTAAATTACTTACTGTGTTTTAGAGCTAGAAATAGCAAGTTAAAATAAGGCTAGTCCGTTATCAACTTGAAAAAGTGGCACCGAGTCGGTGC | 29248 |
| 77 | SpyCas9-NG | + | GGTCGTAGCGAACTGAGAAGGTTTTAGAGCTAGAAATAGCAAGTTAAAATAAGGCTAGTCCGTTATCAACTTGAAAAAGTGGCACCGAGTCGGTGCgaactttgctgccacaataccTCGGCCCTTCTCAGTTCgcta | 29059 | AAAGAAGTAAAATGCCACTGGTTTTAGAGCTAGAAATAGCAAGTTAAAATAAGGCTAGTCCGTTATCAACTTGAAAAAGTGGCACCGAGTCGGTGC | 29249 |
| 81 | SpyCas9-SpRY | + | GGTCGTAGCGAACTGAGAAGGTTTTAGAGCTAGAAATAGCAAGTTAAAATAAGGCTAGTCCGTTATCAACTTGAAAAAGTGGCACCGAGTCGGTGCgaactttgctgccacaataccTCGGCCCTTCTCAGTTCgcta | 29060 | AAAGAAGTAAAATGCCACTGGTTTTAGAGCTAGAAATAGCAAGTTAAAATAAGGCTAGTCCGTTATCAACTTGAAAAAGTGGCACCGAGTCGGTGC | 29250 |
| 82 | SpyCas9-SpRY | − | AGGAACTTTGCTGCCACAATGTTTTAGAGCTAGAAATAGCAAGTTAAAATAAGGCTAGTCCGTTATCAACTTGAAAAAGTGGCACCGAGTCGGTGCtcgtagcgaactgagaagggcCGAGGTATTGTGGCAGCaaag | 29061 | GGTGTAAATTACTTACTGTTGTTTTAGAGCTAGAAATAGCAAGTTAAAATAAGGCTAGTCCGTTATCAACTTGAAAAAGTGGCACCGAGTCGGTGC | 29251 |
| 86 | ScaCas9-Sc++ | + | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaactttgctgccacaataccTCGGCCCTTCTCAGTTCGctac | 29062 | AAAAGAAGTAAAATGCCACTGTTTTAGAGCTAGAAATAGCAAGTTAAAATAAGGCTAGTCCGTTATCAACTTGAAAAAGTGGCACCGAGTCGGTGC | 29252 |
| 87 | SpyCas9 | + | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaactttgctgccacaataccTCGGCCCTTCTCAGTTCGctac | 29063 | TAAGACTACCTTTCTCCAAAGTTTTAGAGCTAGAAATAGCAAGTTAAAATAAGGCTAGTCCGTTATCAACTTGAAAAAGTGGCACCGAGTCGGTGC | 29253 |

TABLE 4A-continued

Exemplary template RNA sequences and second nick gRNA spacer sequences

Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 90 | SpyCas9-SpRY | + | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaactttgctgccacaataccTCGGCCCTTCTCAGTTCGctac | 29064 | AAGAAGTAAAATGCCACTGAGTTTTAGAGCTAGAAATAGCAAGTTAAAATAAGGCTAGTCCGTTATCAACTTGAAAAAGTGGCACCGAGTCGGTGC | 29254 |
| 91 | SpyCas9-NG | + | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaactttgctgccacaataccTCGGCCCTTCTCAGTTCGctac | 29065 | AAAGAAGTAAAATGCCACTGGTTTTAGAGCTAGAAATAGCAAGTTAAAATAAGGCTAGTCCGTTATCAACTTGAAAAAGTGGCACCGAGTCGGTGC | 29255 |
| 94 | SpyCas9-SpRY | - | TAGGAACTTTGCTGCCACAAGTTTTAGAGCTAGAAATAGCAAGTTAAAATAAGGCTAGTCCGTTATCAACTTGAAAAAGTGGCACCGAGTCGGTGCcgtagcgaactgagaagggcCGAGGTATTGTGGCAGCAaagt | 29066 | GTGTAAATTACTTACTGTTAGTTTTAGAGCTAGAAATAGCAAGTTAAAATAAGGCTAGTCCGTTATCAACTTGAAAAAGTGGCACCGAGTCGGTGC | 29256 |
| 95 | BlatCas9 | + | tatgGGTCGTAGCGAACTGAGAAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTaactttgctgccacaataccTCGGCCCTTCTCAGTTCGctac | 29067 | aaaaAAGAAGTAAAATGCCACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29257 |
| 96 | BlatCas9 | + | tatgGGTCGTAGCGAACTGAGAAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTaactttgctgccacaataccTCGGCCCTTCTCAGTTCGctac | 29068 | aaaaAAGAAGTAAAATGCCACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29258 |
| 99 | Nme2Cas9 | + | tgTATGGGTCGTAGCGAACTGAGAGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAactttgctgccacaataccTCGGCCCTTCTCAGTTCGCtacg | 29069 | tcCGTGTTCCTAAAAAAGAAGTAAGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29259 |
| 100 | SauriCas9 | + | ATGGGTCGTAGCGAACTGAGAGTTTTAGTACTCTGGAAACAGAATCTACTAAAACAAGGCAAAATGCCGTGTTTATCTCGTCAACTTGTTGGCGAGAactttgctgccacaataccTCGGCCCTTCTCAGTTCGCtacg | 29070 | CTTAAGACTACCTTTCTCCAAGTTTTAGTACTCTGGAAACAGAATCTACTAAAACAAGGCAAAATGCCGTGTTTATCTCGTCAACTTGTTGGCGAGA | 29260 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 101 | SauriCas9-KKH | + | ATGGGTCGTAGCGAACTGAGAGTTTTAGTACTCTGGAAACAGAATCTACTAAAACAAGGCAAAATGCCGTGTTTATCTCGTCAACTTGTTGGCGAGAactttgctgccacaataccTCGGCCCTTCTCAGTTCGCtacg | 29071 | AAAAAAGAAGTAAAATGCCACGTTTTAGTACTCTGGAAACAGAATCTACTAAAACAAGGCAAAATGCCGTGTTTATCTCGTCAACTTGTTGGCGAGA | 29261 |
| 104 | ScaCas9-Sc++ | + | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCactttgctgccacaataccTCGGCCCTTCTCAGTTCGCtacg | 29072 | AAAAGAAGTAAAATGCCACTGTTTTAGAGCTAGAAATAGCAAGTTAAAATAAGGCTAGTCCGTTATCAACTTGAAAAAGTGGCACCGAGTCGGTGC | 29262 |
| 105 | SpyCas9 | + | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCactttgctgccacaataccTCGGCCCTTCTCAGTTCGCtacg | 29073 | TAAGACTACCTTTCTCCAAAGTTTTAGAGCTAGAAATAGCAAGTTAAAATAAGGCTAGTCCGTTATCAACTTGAAAAAGTGGCACCGAGTCGGTGC | 29263 |
| 108 | SpyCas9-SpRY | + | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCactttgctgccacaataccTCGGCCCTTCTCAGTTCGCtacg | 29074 | AGAAGTAAAATGCCACTGAGGTTTTAGAGCTAGAAATAGCAAGTTAAAATAAGGCTAGTCCGTTATCAACTTGAAAAAGTGGCACCGAGTCGGTGC | 29264 |
| 109 | SpyCas9-NG | + | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCactttgctgccacaataccTCGGCCCTTCTCAGTTCGCtacg | 29075 | AAAGAAGTAAAATGCCACTGGTTTTAGAGCTAGAAATAGCAAGTTAAAATAAGGCTAGTCCGTTATCAACTTGAAAAAGTGGCACCGAGTCGGTGC | 29265 |
| 112 | SpyCas9-SpRY | - | TTAGGAACTTTGCTGCCACAGTTTTAGAGCTAGAAATAGCAAGTTAAAATAAGGCTAGTCCGTTATCAACTTGAAAAAGTGGCACCGAGTCGGTGCgtagcgaactgagaagggcCGAGGTATTGTGGCAGCAAagtt | 29076 | TGTAAATTACTTACTGTTAAGTTTTAGAGCTAGAAATAGCAAGTTAAAATAAGGCTAGTCCGTTATCAACTTGAAAAAGTGGCACCGAGTCGGTGC | 29266 |
| 113 | BlatCas9 | + | gtatGGGTCGTAGCGAACTGAGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTactttgctgccacaataccTCGGCCCTTCTCAGTTCGCtacg | 29077 | aaaaGAAGTAAAATGCCACTGAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29267 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 114 | BlatCas9 | + | gtatGGGTCGTAGCGAACTGAGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTactttgctgccacaataccTCGGCCCTTCTCAGTTCGCtacg | 29078 | aaaaGAAGTAAAATGCCACTGAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29268 |
| 115 | BlatCas9 | - | gtctTAGGAACTTTGCTGCCACAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTgtagcgaactgagaagggcCGAGGTATTGTGGCAGCAAagtt | 29079 | gtgtAAATTACTTACTGTTAATGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29269 |
| 116 | BlatCas9 | + | gtatGGGTCGTAGCGAACTGAGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTactttgctgccacaataccTCGGCCCTTCTCAGTTCGCtacg | 29080 | aaaaGAAGTAAAATGCCACTGAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29270 |
| 117 | BlatCas9 | - | gtctTAGGAACTTTGCTGCCACAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTgtagcgaactgagaagggcCGAGGTATTGTGGCAGCAAagtt | 29081 | gtgtAAATTACTTACTGTTAATGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29271 |
| 119 | Nme2Cas9 | - | tgGTCTTAGGAACTTTGCTGCCACGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAtagcgaactgagaagggcCGAGGTATTGTGGCAGCAAAgttc | 29082 | gtAAATTACTTACTGTTAATGGAAGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29272 |
| 120 | SauCas9 | + | tgTATGGGTCGTAGCGAACTGAGGTTTTAGTACTCTGGAAACAGAATCTACTAAAACAAGGCAAAATGCCGTGTTTATCTCGTCAACTTGTTGGCGAGActttgctgccacaataccTCGGCCCTTCTCAGTTCGCTacga | 29083 | taAAAAAGAAGTAAAATGCCACTGTTTTAGTACTCTGGAAACAGAATCTACTAAAACAAGGCAAAATGCCGTGTTTATCTCGTCAACTTGTTGGCGAGA | 29273 |
| 121 | SauCas9KKH | + | TATGGGTCGTAGCGAACTGAGGTTTTAGTACTCTGGAAACAGAATCTACTAAAACAAGGCAAAATGCCGTGTTTATCT | 29084 | AAAAAGAAGTAAAATGCCACTGTTTTAGTACTCTGGAAACAGAATCTACTAAAACAAG | 29274 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | CGTCAACTTGTTGGCGAGActttgctgccacaataccTCGGCCCTTC TCAGTTCGCTacga | | GCAAAATGCCGTGTTTATCTCGTCAACTT GTTGGCGAGA | |
| 122 | SauriCas9 | + | TATGGGTCGTAGCGAACTGAGGTTTTAGTACTCTGGAAA CAGAATCTACTAAAACAAGGCAAAATGCCGTGTTTATCT CGTCAACTTGTTGGCGAGActttgctgccacaataccTCGGCCCTTC TCAGTTCGCTacga | 29085 | CTTAAGACTACCTTTCTCCAAGTTTTAGTA CTCTGGAAACAGAATCTACTAAAACAAGG CAAAATGCCGTGTTTATCTCGTCAACTTGT TGGCGAGA | 29275 |
| 123 | SauriCas9-KKH | + | TATGGGTCGTAGCGAACTGAGGTTTTAGTACTCTGGAAA CAGAATCTACTAAAACAAGGCAAAATGCCGTGTTTATCT CGTCAACTTGTTGGCGAGActttgctgccacaataccTCGGCCCTTC TCAGTTCGCTacga | 29086 | AAAAAAGAAGTAAAATGCCACGTTTTAGT ACTCTGGAAACAGAATCTACTAAAACAAG GCAAAATGCCGTGTTTATCTCGTCAACTT GTTGGCGAGA | 29276 |
| 126 | ScaCas9-Sc++ | + | ATGGGTCGTAGCGAACTGAGGTTTTAGAGCTAGAAATAG CAAGTTAAAATAAGGCTAGTCCGTTATCAACTTGAAAAA GTGGCACCGAGTCGGTGCctttgctgccacaataccTCGGCCCTTCT CAGTTCGCTacga | 29087 | AAAAGAAGTAAAATGCCACTGTTTTAGAG CTAGAAATAGCAAGTTAAAATAAGGCTA GTCCGTTATCAACTTGAAAAAGTGGCACC GAGTCGGTGC | 29277 |
| 127 | SpyCas9-SpRY | + | ATGGGTCGTAGCGAACTGAGGTTTTAGAGCTAGAAATAG CAAGTTAAAATAAGGCTAGTCCGTTATCAACTTGAAAAA GTGGCACCGAGTCGGTGCctttgctgccacaataccTCGGCCCTTCT CAGTTCGCTacga | 29088 | GAAGTAAAATGCCACTGAGAGTTTTAGAG CTAGAAATAGCAAGTTAAAATAAGGCTA GTCCGTTATCAACTTGAAAAAGTGGCACC GAGTCGGTGC | 29278 |
| 128 | SpyCas9-SpRY | - | CTTAGGAACTTTGCTGCCACGTTTTAGAGCTAGAAATAGC AAGTTAAAATAAGGCTAGTCCGTTATCAACTTGAAAAAG TGGCACCGAGTCGGTGCtagcgaactgagaagggcCGAGGTATTGT GGCAGCAAAgttc | 29089 | GTAAATTACTTACTGTTAATGTTTTAGAGC TAGAAATAGCAAGTTAAAATAAGGCTAGT CCGTTATCAACTTGAAAAAGTGGCACCGA GTCGGTGC | 29279 |
| 129 | BlatCas9 | - | ggtcTTAGGAACTTTGCTGCCACGCTATAGTTCCTTACTGA AAGGTAAGTTGCTATAGTAAGGGCAACAGACCCGAGGCG TTGGGGATCGCCTAGCCCGTGTTTACGGGCTCTCCCCATA TTCAAAATAATGACAGACGAGCACCTTGGAGCATTTATC TCCGAGGTGCTTagcgaactgagaagggcCGAGGTATTGTGGCAGC AAAgttc | 29090 | gtgtAAATTACTTACTGTTAATGGCTATAGT TCCTTACTGAAAGGTAAGTTGCTATAGTA AGGGCAACAGACCCGAGGCGTTGGGGAT CGCCTAGCCCGTGTTTACGGGCTCTCCCC ATATTCAAAATAATGACAGACGAGCACCT TGGAGCATTTATCTCCGAGGTGCT | 29280 |
| 130 | BlatCas9 | - | ggtcTTAGGAACTTTGCTGCCACGCTATAGTTCCTTACTGA AAGGTAAGTTGCTATAGTAAGGGCAACAGACCCGAGGCG TTGGGGATCGCCTAGCCCGTGTTTACGGGCTCTCCCCATA TTCAAAATAATGACAGACGAGCACCTTGGAGCATTTATC TCCGAGGTGCTTagcgaactgagaagggcCGAGGTATTGTGGCAGC AAAgttc | 29091 | gtgtAAATTACTTACTGTTAATGGCTATAGT TCCTTACTGAAAGGTAAGTTGCTATAGTA AGGGCAACAGACCCGAGGCGTTGGGGAT CGCCTAGCCCGTGTTTACGGGCTCTCCCC ATATTCAAAATAATGACAGACGAGCACCT TGGAGCATTTATCTCCGAGGTGCT | 29281 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 134 | SauCas9KKH | + | GTATGGGTCGTAGCGAACTGAGTTTTAGTACTCTGGAAACAGAATCTACTAAAACAAGGCAAAATGCCGTGTTTATCTCGTCAACTTGTTGGCGAGAtttgctgccacaataccTCGGCCCTTCTCAGTTCGCTAcgac | 29092 | TAAAATGCCACTGAGAACTCTGTTTTAGTACTCTGGAAACAGAATCTACTAAAACAAGGCAAAATGCCGTGTTTATCTCGTCAACTTGTTGGCGAGA | 29282 |
| 135 | SauriCas9-KKH | + | GTATGGGTCGTAGCGAACTGAGTTTTAGTACTCTGGAAACAGAATCTACTAAAACAAGGCAAAATGCCGTGTTTATCTCGTCAACTTGTTGGCGAGAtttgctgccacaataccTCGGCCCTTCTCAGTTCGCTAcgac | 29093 | AAATGCCACTGAGAACTCTCTGTTTTAGTACTCTGGAAACAGAATCTACTAAAACAAGGCAAAATGCCGTGTTTATCTCGTCAACTTGTTGGCGAGA | 29283 |
| 138 | SpyCas9-SpRY | + | TATGGGTCGTAGCGAACTGAGTTTTAGAGCTAGAAATAGCAAGTTAAAATAAGGCTAGTCCGTTATCAACTTGAAAAAGTGGCACCGAGTCGGTGCtttgctgccacaataccTCGGCCCTTCTCAGTTCGCTAcgac | 29094 | AAGTAAAATGCCACTGAGAAGTTTTAGAGCTAGAAATAGCAAGTTAAAATAAGGCTAGTCCGTTATCAACTTGAAAAAGTGGCACCGAGTCGGTGC | 29284 |
| 140 | SpyCas9-SpRY | - | TCTTAGGAACTTTGCTGCCAGTTTTAGAGCTAGAAATAGCAAGTTAAAATAAGGCTAGTCCGTTATCAACTTGAAAAAGTGGCACCGAGTCGGTGCagcgaactgagaagggcCGAGGTATTGTGGCAGCAAAGttcc | 29095 | TAAATTACTTACTGTTAATGGTTTTAGAGCTAGAAATAGCAAGTTAAAATAAGGCTAGTCCGTTATCAACTTGAAAAAGTGGCACCGAGTCGGTGC | 29285 |
| 146 | SauCas9KKH | + | TGTATGGGTCGTAGCGAACTGGTTTTAGTACTCTGGAAACAGAATCTACTAAAACAAGGCAAAATGCCGTGTTTATCTCGTCAACTTGTTGGCGAGAttgctgccacaataccTCGGCCCTTCTCAGTTCGCTACgacc | 29096 | TAAAATGCCACTGAGAACTCTGTTTTAGTACTCTGGAAACAGAATCTACTAAAACAAGGCAAAATGCCGTGTTTATCTCGTCAACTTGTTGGCGAGA | 29286 |
| 147 | SpyCas9-NG | + | GTATGGGTCGTAGCGAACTGGTTTTAGAGCTAGAAATAGCAAGTTAAAATAAGGCTAGTCCGTTATCAACTTGAAAAAGTGGCACCGAGTCGGTGCttgctgccacaataccTCGGCCCTTCTCAGTTCGCTACgacc | 29097 | AAAGAAGTAAAATGCCACTGGTTTTAGAGCTAGAAATAGCAAGTTAAAATAAGGCTAGTCCGTTATCAACTTGAAAAAGTGGCACCGAGTCGGTGC | 29287 |
| 151 | SpyCas9-SpRY | + | GTATGGGTCGTAGCGAACTGGTTTTAGAGCTAGAAATAGCAAGTTAAAATAAGGCTAGTCCGTTATCAACTTGAAAAAGTGGCACCGAGTCGGTGCttgctgccacaataccTCGGCCCTTCTCAGTTCGCTACgacc | 29098 | AGTAAAATGCCACTGAGAACGTTTTAGAGCTAGAAATAGCAAGTTAAAATAAGGCTAGTCCGTTATCAACTTGAAAAAGTGGCACCGAGTCGGTGC | 29288 |
| 152 | SpyCas9-SpRY | - | GTCTTAGGAACTTTGCTGCCGTTTTAGAGCTAGAAATAGCAAGTTAAAATAAGGCTAGTCCGTTATCAACTTGAAAAAGTGGCACCGAGTCGGTGCgcgaactgagaagggcCGAGGTATTGTGGCAGCAAAGTtcct | 29099 | AAATTACTTACTGTTAATGGGTTTTAGAGCTAGAAATAGCAAGTTAAAATAAGGCTAGTCCGTTATCAACTTGAAAAAGTGGCACCGAGTCGGTGC | 29289 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 158 | SauCas9 | + | ggGTGTATGGGTCGTAGCGAACTGTTTTAGTACTCTGGAAACAGAATCTACTAAAACAAGGCAAAATGCCGTGTTTATCTCGTCAACTTGTTGGCGAGAtgctgccacaataccTCGGCCCTTCTCAGTTCGCTACGaccc | 29100 | taAAAAAGAAGTAAAATGCCACTGTTTTAGTACTCTGGAAACAGAATCTACTAAAACAAGGCAAAATGCCGTGTTTATCTCGTCAACTTGTTGGCGAGA | 29290 |
| 159 | SauCas9KKH | + | GTGTATGGGTCGTAGCGAACTGTTTTAGTACTCTGGAAACAGAATCTACTAAAACAAGGCAAAATGCCGTGTTTATCTCGTCAACTTGTTGGCGAGAtgctgccacaataccTCGGCCCTTCTCAGTTCGCTACGaccc | 29101 | TAAAATGCCACTGAGAACTCTGTTTTAGTACTCTGGAAACAGAATCTACTAAAACAAGGCAAAATGCCGTGTTTATCTCGTCAACTTGTTGGCGAGA | 29291 |
| 160 | SauCas9KKH | - | TGGTCTTAGGAACTTTGCTGCGTTTTAGTACTCTGGAAACAGAATCTACTAAAACAAGGCAAAATGCCGTGTTTATCTCGTCAACTTGTTGGCGAGAcgaactgagaagggcCGAGGTATTGTGGCAGCAAAGTTccta | 29102 | AAATTACTTACTGTTAATGGAGTTTTAGTACTCTGGAAACAGAATCTACTAAAACAAGGCAAAATGCCGTGTTTATCTCGTCAACTTGTTGGCGAGA | 29292 |
| 161 | SauCas9KKH | - | TGGTCTTAGGAACTTTGCTGCGTTTTAGTACTCTGGAAACAGAATCTACTAAAACAAGGCAAAATGCCGTGTTTATCTCGTCAACTTGTTGGCGAGAcgaactgagaagggcCGAGGTATTGTGGCAGCAAAGTTccta | 29103 | AAATTACTTACTGTTAATGGAGTTTTAGTACTCTGGAAACAGAATCTACTAAAACAAGGCAAAATGCCGTGTTTATCTCGTCAACTTGTTGGCGAGA | 29293 |
| 166 | ScaCas9-Sc++ | + | TGTATGGGTCGTAGCGAACTGTTTTAGAGCTAGAAATAGCAAGTTAAAATAAGGCTAGTCCGTTATCAACTTGAAAAAGTGGCACCGAGTCGGTGCtgctgccacaataccTCGGCCCTTCTCAGTTCGCTACGaccc | 29104 | ATGCCACTGAGAACTCTCTTGTTTTAGAGCTAGAAATAGCAAGTTAAAATAAGGCTAGTCCGTTATCAACTTGAAAAAGTGGCACCGAGTCGGTGC | 29294 |
| 167 | SpyCas9-SpRY | + | TGTATGGGTCGTAGCGAACTGTTTTAGAGCTAGAAATAGCAAGTTAAAATAAGGCTAGTCCGTTATCAACTTGAAAAAGTGGCACCGAGTCGGTGCtgctgccacaataccTCGGCCCTTCTCAGTTCGCTACGaccc | 29105 | GTAAAATGCCACTGAGAACTGTTTTAGAGCTAGAAATAGCAAGTTAAAATAAGGCTAGTCCGTTATCAACTTGAAAAAGTGGCACCGAGTCGGTGC | 29295 |
| 168 | SpyCas9-SpRY | - | GGTCTTAGGAACTTTGCTGCGTTTTAGAGCTAGAAATAGCAAGTTAAAATAAGGCTAGTCCGTTATCAACTTGAAAAAGTGGCACCGAGTCGGTGCcgaactgagaagggcCGAGGTATTGTGGCAGCAAAGTTccta | 29106 | AATTACTTACTGTTAATGGAGTTTTAGAGCTAGAAATAGCAAGTTAAAATAAGGCTAGTCCGTTATCAACTTGAAAAAGTGGCACCGAGTCGGTGC | 29296 |
| 174 | SauCas9KKH | + | GGTGTATGGGTCGTAGCGAACGTTTTAGTACTCTGGAAACAGAATCTACTAAAACAAGGCAAAATGCCGTGTTTATCTCGTCAACTTGTTGGCGAGAgctgccacaataccTCGGCCCTTCTCAGTTCGCTACGAccca | 29107 | TAAAATGCCACTGAGAACTCTGTTTTAGTACTCTGGAAACAGAATCTACTAAAACAAGGCAAAATGCCGTGTTTATCTCGTCAACTTGTTGGCGAGA | 29297 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 175 | SauriCas9-KKH | + | GGTGTATGGGTCGTAGCGAACGTTTTAGTACTCTGGAAACAGAATCTACTAAAACAAGGCAAAATGCCGTGTTTATCTCGTCAACTTGTTGGCGAGAgctgccacaataccTCGGCCCTTCTCAGTTCGCTACGAccca | 29108 | AAATGCCACTGAGAACTCTCTGTTTTAGTACTCTGGAAACAGAATCTACTAAAACAAGGCAAAATGCCGTGTTTATCTCGTCAACTTGTTGGCGAGA | 29298 |
| 177 | SpyCas9-NG | + | GTGTATGGGTCGTAGCGAACGTTTTAGAGCTAGAAATAGCAAGTTAAAATAAGGCTAGTCCGTTATCAACTTGAAAAAGTGGCACCGAGTCGGTGCgctgccacaataccTCGGCCCTTCTCAGTTCGCTACGAccca | 29109 | TGCCACTGAGAACTCTCTTAGTTTTAGAGCTAGAAATAGCAAGTTAAAATAAGGCTAGTCCGTTATCAACTTGAAAAAGTGGCACCGAGTCGGTGC | 29299 |
| 181 | SpyCas9-SpRY | + | GTGTATGGGTCGTAGCGAACGTTTTAGAGCTAGAAATAGCAAGTTAAAATAAGGCTAGTCCGTTATCAACTTGAAAAAGTGGCACCGAGTCGGTGCgctgccacaataccTCGGCCCTTCTCAGTTCGCTACGAccca | 29110 | TAAAATGCCACTGAGAACTCGTTTTAGAGCTAGAAATAGCAAGTTAAAATAAGGCTAGTCCGTTATCAACTTGAAAAAGTGGCACCGAGTCGGTGC | 29300 |
| 182 | SpyCas9-SpRY | − | TGGTCTTAGGAACTTTGCTGGTTTTAGAGCTAGAAATAGCAAGTTAAAATAAGGCTAGTCCGTTATCAACTTGAAAAAGTGGCACCGAGTCGGTGCgaactgagaagggcCGAGGTATTGTGGCAGCAAAGTTCctaa | 29111 | ATTACTTACTGTTAATGGAAGTTTTAGAGCTAGAAATAGCAAGTTAAAATAAGGCTAGTCCGTTATCAACTTGAAAAAGTGGCACCGAGTCGGTGC | 29301 |
| 187 | SauCas9 | + | ttGGGTGTATGGGTCGTAGCGAAGTTTTAGTACTCTGGAAACAGAATCTACTAAAACAAGGCAAAATGCCGTGTTTATCTCGTCAACTTGTTGGCGAGActgccacaataccTCGGCCCTTCTCAGTTCGCTACGACccat | 29112 | taAAAAAGAAGTAAAATGCCACTGTTTTAGTACTCTGGAAACAGAATCTACTAAAACAAGGCAAAATGCCGTGTTTATCTCGTCAACTTGTTGGCGAGA | 29302 |
| 188 | SauCas9KKH | + | GGGTGTATGGGTCGTAGCGAAGTTTTAGTACTCTGGAAACAGAATCTACTAAAACAAGGCAAAATGCCGTGTTTATCTCGTCAACTTGTTGGCGAGActgccacaataccTCGGCCCTTCTCAGTTCGCTACGACccat | 29113 | TAAAATGCCACTGAGAACTCTGTTTTAGTACTCTGGAAACAGAATCTACTAAAACAAGGCAAAATGCCGTGTTTATCTCGTCAACTTGTTGGCGAGA | 29303 |
| 191 | ScaCas9-Sc++ | + | GGTGTATGGGTCGTAGCGAAGTTTTAGAGCTAGAAATAGCAAGTTAAAATAAGGCTAGTCCGTTATCAACTTGAAAAAGTGGCACCGAGTCGGTGCctgccacaataccTCGGCCCTTCTCAGTTCGCTACGACccat | 29114 | ATGCCACTGAGAACTCTCTTGTTTTAGAGCTAGAAATAGCAAGTTAAAATAAGGCTAGTCCGTTATCAACTTGAAAAAGTGGCACCGAGTCGGTGC | 29304 |
| 192 | SpyCas9-SpRY | + | GGTGTATGGGTCGTAGCGAAGTTTTAGAGCTAGAAATAGCAAGTTAAAATAAGGCTAGTCCGTTATCAACTTGAAAAAGTGGCACCGAGTCGGTGCctgccacaataccTCGGCCCTTCTCAGTTCGCTACGACccat | 29115 | AAAATGCCACTGAGAACTCTGTTTTAGAGCTAGAAATAGCAAGTTAAAATAAGGCTAGTCCGTTATCAACTTGAAAAAGTGGCACCGAGTCGGTGC | 29305 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 193 | SpyCas9-SpRY | - | TTGGTCTTAGGAACTTTGCTGTTTTAGAGCTAGAAATAGCAAGTTAAAATAAGGCTAGTCCGTTATCAACTTGAAAAAGTGGCACCGAGTCGGTGCaactgagaagggcCGAGGTATTGTGGCAGCAAAGTTCCtaag | 29116 | TTACTTACTGTTAATGGAATGTTTTAGAGCTAGAAATAGCAAGTTAAAATAAGGCTAGTCCGTTATCAACTTGAAAAAGTGGCACCGAGTCGGTGC | 29306 |
| 194 | BlatCas9 | - | gtttTGGTCTTAGGAACTTTGCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTaactgagaagggcCGAGGTATTGTGGCAGCAAAGTTCCtaag | 29117 | aaatTACTTACTGTTAATGGAATGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29307 |
| 195 | BlatCas9 | - | gtttTGGTCTTAGGAACTTTGCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTaactgagaagggcCGAGGTATTGTGGCAGCAAAGTTCCtaag | 29118 | aaatTACTTACTGTTAATGGAATGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29308 |
| 198 | SauCas9KKH | + | TGGGTGTATGGGTCGTAGCGAGTTTTAGTACTCTGGAAACAGAATCTACTAAAACAAGGCAAAATGCCGTGTTTATCTCGTCAACTTGTTGGCGAGAtgccacaataccTCGGCCCTTCTCAGTTCGCTACGACCcata | 29119 | AAAATGCCACTGAGAACTCTCGTTTTAGTACTCTGGAAACAGAATCTACTAAAACAAGGCAAAATGCCGTGTTTATCTCGTCAACTTGTTGGCGAGA | 29309 |
| 199 | SpyCas9-NG | - | TTTGGTCTTAGGAACTTTGCGTTTTAGAGCTAGAAATAGCAAGTTAAAATAAGGCTAGTCCGTTATCAACTTGAAAAAGTGGCACCGAGTCGGTGCactgagaagggcCGAGGTATTGTGGCAGCAAAGTTCCTaaga | 29120 | TACTTACTGTTAATGGAATCGTTTTAGAGCTAGAAATAGCAAGTTAAAATAAGGCTAGTCCGTTATCAACTTGAAAAAGTGGCACCGAGTCGGTGC | 29310 |
| 203 | SpyCas9-SpRY | - | TTTGGTCTTAGGAACTTTGCGTTTTAGAGCTAGAAATAGCAAGTTAAAATAAGGCTAGTCCGTTATCAACTTGAAAAAGTGGCACCGAGTCGGTGCactgagaagggcCGAGGTATTGTGGCAGCAAAGTTCCTaaga | 29121 | TACTTACTGTTAATGGAATCGTTTTAGAGCTAGAAATAGCAAGTTAAAATAAGGCTAGTCCGTTATCAACTTGAAAAAGTGGCACCGAGTCGGTGC | 29311 |
| 204 | SpyCas9-SpRY | + | GGGTGTATGGGTCGTAGCGAGTTTTAGAGCTAGAAATAGCAAGTTAAAATAAGGCTAGTCCGTTATCAACTTGAAAAAGTGGCACCGAGTCGGTGCtgccacaataccTCGGCCCTTCTCAGTTCGCTACGACCcata | 29122 | AAATGCCACTGAGAACTCTCGTTTTAGAGCTAGAAATAGCAAGTTAAAATAAGGCTAGTCCGTTATCAACTTGAAAAAGTGGCACCGAGTCGGTGC | 29312 |
| 208 | ScaCas9-Sc++ | - | TTTTGGTCTTAGGAACTTTGGTTTTAGAGCTAGAAATAGCAAGTTAAAATAAGGCTAGTCCGTTATCAACTTGAAAAAG | 29123 | TTACTTACTGTTAATGGAATGTTTTAGAGCTAGAAATAGCAAGTTAAAATAAGGCTAGT | 29313 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | TGGCACCGAGTCGGTGCctgagaagggcCGAGGTATTGTGGCAGCAAAGTTCCTAagac | | CCGTTATCAACTTGAAAAAGTGGCACCGAGTCGGTGC | |
| 209 | SpyCas9-SpRY | - | TTTTGGTCTTAGGAACTTTGGTTTTAGAGCTAGAAATAGCAAGTTAAAATAAGGCTAGTCCGTTATCAACTTGAAAAAGTGGCACCGAGTCGGTGCctgagaagggcCGAGGTATTGTGGCAGCAAAGTTCCTAagac | 29124 | ACTTACTGTTAATGGAATCAGTTTTAGAGCTAGAAATAGCAAGTTAAAATAAGGCTAGTCCGTTATCAACTTGAAAAAGTGGCACCGAGTCGGTGC | 29314 |
| 210 | SpyCas9-SpRY | + | TGGGTGTATGGGTCGTAGCGGTTTTAGAGCTAGAAATAGCAAGTTAAAATAAGGCTAGTCCGTTATCAACTTGAAAAAGTGGCACCGAGTCGGTGCgccacaataccTCGGCCCTTCTCAGTTCGCTACGACCCatac | 29125 | AATGCCACTGAGAACTCTCTGTTTTAGAGCTAGAAATAGCAAGTTAAAATAAGGCTAGTCCGTTATCAACTTGAAAAAGTGGCACCGAGTCGGTGC | 29315 |
| 211 | BlatCas9 | - | tggtTTTGGTCTTAGGAACTTTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTctgagaagggcCGAGGTATTGTGGCAGCAAAGTTCCTAagac | 29126 | aaatTACTTACTGTTAATGGAATGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29316 |
| 214 | Nme2Cas9 | - | tgTGGTTTTGGTCTTAGGAACTTTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAtgagaagggcCGAGGTATTGTGGCAGCAAAGTTCCTAAgacc | 29127 | gtAAATTACTTACTGTTAATGGAAGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29317 |
| 215 | SpyCas9-SpRY | + | TTGGGTGTATGGGTCGTAGCGTTTTAGAGCTAGAAATAGCAAGTTAAAATAAGGCTAGTCCGTTATCAACTTGAAAAAGTGGCACCGAGTCGGTGCccacaataccTCGGCCCTTCTCAGTTCGCTACGACCCAtaca | 29128 | ATGCCACTGAGAACTCTCTTGTTTTAGAGCTAGAAATAGCAAGTTAAAATAAGGCTAGTCCGTTATCAACTTGAAAAAGTGGCACCGAGTCGGTGC | 29318 |
| 217 | SpyCas9-SpRY | - | GTTTTGGTCTTAGGAACTTTGTTTTAGAGCTAGAAATAGCAAGTTAAAATAAGGCTAGTCCGTTATCAACTTGAAAAAGTGGCACCGAGTCGGTGCtgagaagggcCGAGGTATTGTGGCAGCAAAGTTCCTAAgacc | 29129 | CTTACTGTTAATGGAATCAGGTTTTAGAGCTAGAAATAGCAAGTTAAAATAAGGCTAGTCCGTTATCAACTTGAAAAAGTGGCACCGAGTCGGTGC | 29319 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 218 | BlatCas9 | - | gtggTTTTGGTCTTAGGAACTTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTgagaagggcCGAGGTATTGTGGCAGCAAAGTTCCTAAgacc | 29130 | cttaCTGTTAATGGAATCAGCCAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29320 |
| 221 | SpyCas9-NG | + | TTTGGGTGTATGGGTCGTAGGTTTTAGAGCTAGAAATAGCAAGTTAAAATAAGGCTAGTCCGTTATCAACTTGAAAAAGTGGCACCGAGTCGGTGCcacaataccTCGGCCCTTCTCAGTTCGCTACGACCCATacac | 29131 | TGCCACTGAGAACTCTCTTAGTTTTAGAGCTAGAAATAGCAAGTTAAAATAAGGCTAGTCCGTTATCAACTTGAAAAAGTGGCACCGAGTCGGTGC | 29321 |
| 224 | SpyCas9-NG | - | GGTTTTGGTCTTAGGAACTTGTTTTAGAGCTAGAAATAGCAAGTTAAAATAAGGCTAGTCCGTTATCAACTTGAAAAAGTGGCACCGAGTCGGTGCgagaagggcCGAGGTATTGTGGCAGCAAAGTTCCTAAGacca | 29132 | TACTTACTGTTAATGGAATCGTTTTAGAGCTAGAAATAGCAAGTTAAAATAAGGCTAGTCCGTTATCAACTTGAAAAAGTGGCACCGAGTCGGTGC | 29322 |
| 228 | SpyCas9-SpRY | + | TTTGGGTGTATGGGTCGTAGGTTTTAGAGCTAGAAATAGCAAGTTAAAATAAGGCTAGTCCGTTATCAACTTGAAAAAGTGGCACCGAGTCGGTGCcacaataccTCGGCCCTTCTCAGTTCGCTACGACCCATacac | 29133 | TGCCACTGAGAACTCTCTTAGTTTTAGAGCTAGAAATAGCAAGTTAAAATAAGGCTAGTCCGTTATCAACTTGAAAAAGTGGCACCGAGTCGGTGC | 29323 |
| 230 | SpyCas9-SpRY | - | GGTTTTGGTCTTAGGAACTTGTTTTAGAGCTAGAAATAGCAAGTTAAAATAAGGCTAGTCCGTTATCAACTTGAAAAAGTGGCACCGAGTCGGTGCgagaagggcCGAGGTATTGTGGCAGCAAAGTTCCTAAGacca | 29134 | TTACTGTTAATGGAATCAGCGTTTTAGAGCTAGAAATAGCAAGTTAAAATAAGGCTAGTCCGTTATCAACTTGAAAAAGTGGCACCGAGTCGGTGC | 29324 |
| 231 | BlatCas9 | + | tcctTTGGGTGTATGGGTCGTAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcacaataccTCGGCCCTTCTCAGTTCGCTACGACCCATacac | 29135 | aaaaTGCCACTGAGAACTCTCTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29325 |
| 232 | BlatCas9 | + | tcctTTGGGTGTATGGGTCGTAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcacaataccTCGGCCCTTCTCAGTTCGCTACGACCCATacac | 29136 | aaaaTGCCACTGAGAACTCTCTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29326 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 238 | SauCas9 | + | atCCTTTGGGTGTATGGGTCGTAGTTTTAGTACTCTGGAAACAGAATCTACTAAAACAAGGCAAAATGCCGTGTTTATCTCGTCAACTTGTTGGCGAGAacaataccTCGGCCCTTCTCAGTTCGCTACGACCCATAcacc | 29137 | taAAAAAGAAGTAAAATGCCACTGTTTTAGTACTCTGGAAACAGAATCTACTAAAACAAGGCAAAATGCCGTGTTTATCTCGTCAACTTGTTGGCGAGA | 29327 |
| 239 | SauCas9KKH | + | CCTTTGGGTGTATGGGTCGTAGTTTTAGTACTCTGGAAACAGAATCTACTAAAACAAGGCAAAATGCCGTGTTTATCTCGTCAACTTGTTGGCGAGAacaataccTCGGCCCTTCTCAGTTCGCTACGACCCATAcacc | 29138 | AAATGCCACTGAGAACTCTCTGTTTTAGTACTCTGGAAACAGAATCTACTAAAACAAGGCAAAATGCCGTGTTTATCTCGTCAACTTGTTGGCGAGA | 29328 |
| 242 | ScaCas9-Sc++ | + | CTTTGGGTGTATGGGTCGTAGTTTTAGAGCTAGAAATAGCAAGTTAAAATAAGGCTAGTCCGTTATCAACTTGAAAAAGTGGCACCGAGTCGGTGCacaataccTCGGCCCTTCTCAGTTCGCTACGACCCATAcacc | 29139 | ATGCCACTGAGAACTCTCTTGTTTTAGAGCTAGAAATAGCAAGTTAAAATAAGGCTAGTCCGTTATCAACTTGAAAAAGTGGCACCGAGTCGGTGC | 29329 |
| 243 | SpyCas9-SpRY | + | CTTTGGGTGTATGGGTCGTAGTTTTAGAGCTAGAAATAGCAAGTTAAAATAAGGCTAGTCCGTTATCAACTTGAAAAAGTGGCACCGAGTCGGTGCacaataccTCGGCCCTTCTCAGTTCGCTACGACCCATAcacc | 29140 | GCCACTGAGAACTCTCTTAAGTTTTAGAGCTAGAAATAGCAAGTTAAAATAAGGCTAGTCCGTTATCAACTTGAAAAAGTGGCACCGAGTCGGTGC | 29330 |
| 246 | ScaCas9-Sc++ | − | TGGTTTTGGTCTTAGGAACTGTTTTAGAGCTAGAAATAGCAAGTTAAAATAAGGCTAGTCCGTTATCAACTTGAAAAAGTGGCACCGAGTCGGTGCagaagggcCGAGGTATTGTGGCAGCAAAGTTCCTAAGAccaa | 29141 | TTACTTACTGTTAATGGAATGTTTTAGAGCTAGAAATAGCAAGTTAAAATAAGGCTAGTCCGTTATCAACTTGAAAAAGTGGCACCGAGTCGGTGC | 29331 |
| 247 | SpyCas9-SpRY | − | TGGTTTTGGTCTTAGGAACTGTTTTAGAGCTAGAAATAGCAAGTTAAAATAAGGCTAGTCCGTTATCAACTTGAAAAAGTGGCACCGAGTCGGTGCagaagggcCGAGGTATTGTGGCAGCAAAGTTCCTAAGAccaa | 29142 | TACTGTTAATGGAATCAGCCGTTTTAGAGCTAGAAATAGCAAGTTAAAATAAGGCTAGTCCGTTATCAACTTGAAAAAGTGGCACCGAGTCGGTGC | 29332 |
| 251 | SauCas9KKH | + | TCCTTTGGGTGTATGGGTCGTGTTTTAGTACTCTGGAAACAGAATCTACTAAAACAAGGCAAAATGCCGTGTTTATCTCGTCAACTTGTTGGCGAGAcaataccTCGGCCCTTCTCAGTTCGCTACGACCCATACaccc | 29143 | AAATGCCACTGAGAACTCTCTGTTTTAGTACTCTGGAAACAGAATCTACTAAAACAAGGCAAAATGCCGTGTTTATCTCGTCAACTTGTTGGCGAGA | 29333 |
| 252 | SpyCas9-NG | + | CCTTTGGGTGTATGGGTCGTGTTTTAGAGCTAGAAATAGCAAGTTAAAATAAGGCTAGTCCGTTATCAACTTGAAAAAGTGGCACCGAGTCGGTGCcaataccTCGGCCCTTCTCAGTTCGCTACGACCCATACaccc | 29144 | TGCCACTGAGAACTCTCTTAGTTTTAGAGCTAGAAATAGCAAGTTAAAATAAGGCTAGTCCGTTATCAACTTGAAAAAGTGGCACCGAGTCGGTGC | 29334 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 256 | SpyCas9-SpRY | + | CCTTTGGGTGTATGGGTCGTGTTTTAGAGCTAGAAATAGCAAGTTAAAATAAGGCTAGTCCGTTATCAACTTGAAAAAGTGGCACCGAGTCGGTGCcaataccTCGGCCCTTCTCAGTTCGCTACGACCCATACaccc | 29145 | CCACTGAGAACTCTCTTAAGGTTTTAGAGCTAGAAATAGCAAGTTAAAATAAGGCTAGTCCGTTATCAACTTGAAAAAGTGGCACCGAGTCGGTGC | 29335 |
| 257 | SpyCas9-SpRY | − | GTGGTTTTGGTCTTAGGAACGTTTTAGAGCTAGAAATAGCAAGTTAAAATAAGGCTAGTCCGTTATCAACTTGAAAAAGTGGCACCGAGTCGGTGCgaagggcCGAGGTATTGTGGCAGCAAAGTTCCTAAGACcaaa | 29146 | ACTGTTAATGGAATCAGCCAGTTTTAGAGCTAGAAATAGCAAGTTAAAATAAGGCTAGTCCGTTATCAACTTGAAAAAGTGGCACCGAGTCGGTGC | 29336 |
| 258 | BlatCas9 | − | cctgTGGTTTTGGTCTTAGGAACGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTgaagggcCGAGGTATTGTGGCAGCAAAGTTCCTAAGACcaaa | 29147 | cttaCTGTTAATGGAATCAGCCAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29337 |
| 264 | ScaCas9-Sc++ | + | TCCTTTGGGTGTATGGGTCGGTTTTAGAGCTAGAAATAGCAAGTTAAAATAAGGCTAGTCCGTTATCAACTTGAAAAAGTGGCACCGAGTCGGTGCaataccTCGGCCCTTCTCAGTTCGCTACGACCCATACAccca | 29148 | ATGCCACTGAGAACTCTCTTGTTTTAGAGCTAGAAATAGCAAGTTAAAATAAGGCTAGTCCGTTATCAACTTGAAAAAGTGGCACCGAGTCGGTGC | 29338 |
| 265 | SpyCas9-SpRY | + | TCCTTTGGGTGTATGGGTCGGTTTTAGAGCTAGAAATAGCAAGTTAAAATAAGGCTAGTCCGTTATCAACTTGAAAAAGTGGCACCGAGTCGGTGCaataccTCGGCCCTTCTCAGTTCGCTACGACCCATACAccca | 29149 | CACTGAGAACTCTCTTAAGAGTTTTAGAGCTAGAAATAGCAAGTTAAAATAAGGCTAGTCCGTTATCAACTTGAAAAAGTGGCACCGAGTCGGTGC | 29339 |
| 266 | SpyCas9-SpRY | − | TGTGGTTTTGGTCTTAGGAAGTTTTAGAGCTAGAAATAGCAAGTTAAAATAAGGCTAGTCCGTTATCAACTTGAAAAAGTGGCACCGAGTCGGTGCaagggcCGAGGTATTGTGGCAGCAAAGTTCCTAAGACCaaaa | 29150 | CTGTTAATGGAATCAGCCAAGTTTTAGAGCTAGAAATAGCAAGTTAAAATAAGGCTAGTCCGTTATCAACTTGAAAAAGTGGCACCGAGTCGGTGC | 29340 |
| 268 | SauriCas9-KKH | + | AATCCTTTGGGTGTATGGGTCGTTTTAGTACTCTGGAAACAGAATCTACTAAAACAAGGCAAAATGCCGTGTTTATCTCGTCAACTTGTTGGCGAGAataccTCGGCCCTTCTCAGTTCGCTACGACCCATACACccaa | 29151 | AAATGCCACTGAGAACTCTCTGTTTTAGTACTCTGGAAACAGAATCTACTAAAACAAGGCAAAATGCCGTGTTTATCTCGTCAACTTGTTGGCGAGA | 29341 |
| 269 | SpyCas9-SpRY | + | ATCCTTTGGGTGTATGGGTCGTTTTAGAGCTAGAAATAGCAAGTTAAAATAAGGCTAGTCCGTTATCAACTTGAAAAAGTGGCACCGAGTCGGTGCataccTCGGCCCTTCTCAGTTCGCTACGACCCATACACccaa | 29152 | ACTGAGAACTCTCTTAAGACGTTTTAGAGCTAGAAATAGCAAGTTAAAATAAGGCTAGTCCGTTATCAACTTGAAAAAGTGGCACCGAGTCGGTGC | 29342 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 270 | SpyCas9-SpRY | - | CTGTGGTTTTGGTCTTAGGAGTTTTAGAGCTAGAAATAGCAAGTTAAAATAAGGCTAGTCCGTTATCAACTTGAAAAAGTGGCACCGAGTCGGTGCagggcCGAGGTATTGTGGCAGCAAAGTTCCTAAGACCAaaac | 29153 | TGTTAATGGAATCAGCCAAAGTTTTAGAGCTAGAAATAGCAAGTTAAAATAAGGCTAGTCCGTTATCAACTTGAAAAAGTGGCACCGAGTCGGTGC | 29343 |
| 271 | BlatCas9 | + | tcaaTCCTTTGGGTGTATGGGTCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTataccTCGGCCCTTCTCAGTTCGCTACGACCCATACACccaa | 29154 | tgccACTGAGAACTCTCTTAAGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29344 |
| 272 | BlatCas9 | + | tcaaTCCTTTGGGTGTATGGGTCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTataccTCGGCCCTTCTCAGTTCGCTACGACCCATACACccaa | 29155 | tgccACTGAGAACTCTCTTAAGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29345 |
| 274 | BlatCas9 | + | tcaaTCCTTTGGGTGTATGGGTCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTataccTCGGCCCTTCTCAGTTCGCTACGACCCATACACccaa | 29156 | tgccACTGAGAACTCTCTTAAGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29346 |
| 275 | SauCas9KKH | + | CAATCCTTTGGGTGTATGGGTGTTTTAGTACTCTGGAAACAGAATCTACTAAAACAAGGCAAAATGCCGTGTTTATCTCGTCAACTTGTTGGCGAGAtaccTCGGCCCTTCTCAGTTCGCTACGACCCATACACCcaaa | 29157 | ACTCTCTTAAGACTACCTTTCGTTTTAGTACTCTGGAAACAGAATCTACTAAAACAAGGCAAAATGCCGTGTTTATCTCGTCAACTTGTTGGCGAGA | 29347 |
| 276 | SpyCas9-NG | + | AATCCTTTGGGTGTATGGGTGTTTTAGAGCTAGAAATAGCAAGTTAAAATAAGGCTAGTCCGTTATCAACTTGAAAAAGTGGCACCGAGTCGGTGCtaccTCGGCCCTTCTCAGTTCGCTACGACCCATACACCcaaa | 29158 | TGCCACTGAGAACTCTCTTAGTTTTAGAGCTAGAAATAGCAAGTTAAAATAAGGCTAGTCCGTTATCAACTTGAAAAAGTGGCACCGAGTCGGTGC | 29348 |
| 280 | SpyCas9-SpRY | + | AATCCTTTGGGTGTATGGGTGTTTTAGAGCTAGAAATAGCAAGTTAAAATAAGGCTAGTCCGTTATCAACTTGAAAAAGTGGCACCGAGTCGGTGCtaccTCGGCCCTTCTCAGTTCGCTACGACCCATACACCcaaa | 29159 | CTGAGAACTCTCTTAAGACTGTTTTAGAGCTAGAAATAGCAAGTTAAAATAAGGCTAGTCCGTTATCAACTTGAAAAAGTGGCACCGAGTCGGTGC | 29349 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 281 | SpyCas9-SpRY | - | CCTGTGGTTTTGGTCTTAGGGTTTTAGAGCTAGAAATAGCAAGTTAAAATAAGGCTAGTCCGTTATCAACTTGAAAAAGTGGCACCGAGTCGGTGCgggcCGAGGTATTGTGGCAGCAAAGTTCCTAAGACCAAaacc | 29160 | GTTAATGGAATCAGCCAAAAGTTTTAGAGCTAGAAATAGCAAGTTAAAATAAGGCTAGTCCGTTATCAACTTGAAAAAGTGGCACCGAGTCGGTGC | 29350 |
| 286 | ScaCas9-Sc++ | + | CAATCCTTTGGGTGTATGGGGTTTTAGAGCTAGAAATAGCAAGTTAAAATAAGGCTAGTCCGTTATCAACTTGAAAAAGTGGCACCGAGTCGGTGCaccTCGGCCCTTCTCAGTTCGCTACGACCCATACACCCaaag | 29161 | ATGCCACTGAGAACTCTCTTGTTTTAGAGCTAGAAATAGCAAGTTAAAATAAGGCTAGTCCGTTATCAACTTGAAAAAGTGGCACCGAGTCGGTGC | 29351 |
| 287 | SpyCas9-SpRY | + | CAATCCTTTGGGTGTATGGGGTTTTAGAGCTAGAAATAGCAAGTTAAAATAAGGCTAGTCCGTTATCAACTTGAAAAAGTGGCACCGAGTCGGTGCaccTCGGCCCTTCTCAGTTCGCTACGACCCATACACCCaaag | 29162 | TGAGAACTCTCTTAAGACTAGTTTTAGAGCTAGAAATAGCAAGTTAAAATAAGGCTAGTCCGTTATCAACTTGAAAAAGTGGCACCGAGTCGGTGC | 29352 |
| 288 | SpyCas9-SpRY | - | GCCTGTGGTTTTGGTCTTAGGTTTTAGAGCTAGAAATAGCAAGTTAAAATAAGGCTAGTCCGTTATCAACTTGAAAAAGTGGCACCGAGTCGGTGCggcCGAGGTATTGTGGCAGCAAAGTTCCTAAGACCAAAacca | 29163 | TTAATGGAATCAGCCAAAATGTTTTAGAGCTAGAAATAGCAAGTTAAAATAAGGCTAGTCCGTTATCAACTTGAAAAAGTGGCACCGAGTCGGTGC | 29353 |
| 293 | SpyCas9-NG | - | AGCCTGTGGTTTTGGTCTTAGTTTTAGAGCTAGAAATAGCAAGTTAAAATAAGGCTAGTCCGTTATCAACTTGAAAAAGTGGCACCGAGTCGGTGCgcCGAGGTATTGTGGCAGCAAAGTTCCTAAGACCAAAAccac | 29164 | TGGAATCAGCCAAAATCTTAGTTTTAGAGCTAGAAATAGCAAGTTAAAATAAGGCTAGTCCGTTATCAACTTGAAAAAGTGGCACCGAGTCGGTGC | 29354 |
| 297 | SpyCas9-SpRY | - | AGCCTGTGGTTTTGGTCTTAGTTTTAGAGCTAGAAATAGCAAGTTAAAATAAGGCTAGTCCGTTATCAACTTGAAAAAGTGGCACCGAGTCGGTGCgcCGAGGTATTGTGGCAGCAAAGTTCCTAAGACCAAAAccac | 29165 | TAATGGAATCAGCCAAAATCGTTTTAGAGCTAGAAATAGCAAGTTAAAATAAGGCTAGTCCGTTATCAACTTGAAAAAGTGGCACCGAGTCGGTGC | 29355 |
| 298 | SpyCas9-SpRY | + | TCAATCCTTTGGGTGTATGGGTTTTAGAGCTAGAAATAGCAAGTTAAAATAAGGCTAGTCCGTTATCAACTTGAAAAAGTGGCACCGAGTCGGTGCccTCGGCCCTTCTCAGTTCGCTACGACCCATACACCCAaagg | 29166 | GAGAACTCTCTTAAGACTACGTTTTAGAGCTAGAAATAGCAAGTTAAAATAAGGCTAGTCCGTTATCAACTTGAAAAAGTGGCACCGAGTCGGTGC | 29356 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 299 | BlatCas9 | - | tcaaGCCTGTGGTTTTGGTCTTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTGcCGAGGTATTGTGGCAGCAAAGTTCCTAAGACCAAAAccac | 29167 | gttaATGGAATCAGCCAAAATCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29357 |
| 300 | BlatCas9 | - | tcaaGCCTGTGGTTTTGGTCTTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTGcCGAGGTATTGTGGCAGCAAAGTTCCTAAGACCAAAAccac | 29168 | gttaATGGAATCAGCCAAAATCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29358 |
| 306 | SauCas9 | - | ctCAAGCCTGTGGTTTTGGTCTTGTTTTAGTACTCTGGAAACAGAATCTACTAAAACAAGGCAAAATGCCGTGTTTATCTCGTCAACTTGTTGGCGAGAcCGAGGTATTGTGGCAGCAAAGTTCCTAAGACCAAAACcaca | 29169 | gaATCAGCCAAAATCTTAAGCTGGTTTTAGTACTCTGGAAACAGAATCTACTAAAACAAGGCAAAATGCCGTGTTTATCTCGTCAACTTGTTGGCGAGA | 29359 |
| 307 | SauCas9KKH | - | CAAGCCTGTGGTTTTGGTCTTGTTTTAGTACTCTGGAAACAGAATCTACTAAAACAAGGCAAAATGCCGTGTTTATCTCGTCAACTTGTTGGCGAGAcCGAGGTATTGTGGCAGCAAAGTTCCTAAGACCAAAACcaca | 29170 | TTAATGGAATCAGCCAAAATCGTTTTAGTACTCTGGAAACAGAATCTACTAAAACAAGGCAAAATGCCGTGTTTATCTCGTCAACTTGTTGGCGAGA | 29360 |
| 310 | ScaCas9-Sc++ | - | AAGCCTGTGGTTTTGGTCTTGTTTTAGAGCTAGAAATAGCAAGTTAAAATAAGGCTAGTCCGTTATCAACTTGAAAAAGTGGCACCGAGTCGGTGCcCGAGGTATTGTGGCAGCAAAGTTCCTAAGACCAAAACcaca | 29171 | ATGGAATCAGCCAAAATCTTGTTTTAGAGCTAGAAATAGCAAGTTAAAATAAGGCTAGTCCGTTATCAACTTGAAAAAGTGGCACCGAGTCGGTGC | 29361 |
| 311 | SpyCas9 | - | AAGCCTGTGGTTTTGGTCTTGTTTTAGAGCTAGAAATAGCAAGTTAAAATAAGGCTAGTCCGTTATCAACTTGAAAAAGTGGCACCGAGTCGGTGCcCGAGGTATTGTGGCAGCAAAGTTCCTAAGACCAAAACcaca | 29172 | CAGCCAAAATCTTAAGCTGCGTTTTAGAGCTAGAAATAGCAAGTTAAAATAAGGCTAGTCCGTTATCAACTTGAAAAAGTGGCACCGAGTCGGTGC | 29362 |
| 314 | SpyCas9-SpRY | - | AAGCCTGTGGTTTTGGTCTTGTTTTAGAGCTAGAAATAGCAAGTTAAAATAAGGCTAGTCCGTTATCAACTTGAAAAAGTGGCACCGAGTCGGTGCcCGAGGTATTGTGGCAGCAAAGTTCCTAAGACCAAAACcaca | 29173 | AATGGAATCAGCCAAAATCTGTTTTAGAGCTAGAAATAGCAAGTTAAAATAAGGCTAGTCCGTTATCAACTTGAAAAAGTGGCACCGAGTCGGTGC | 29363 |
| 315 | SpyCas9-NG | + | CTCAATCCTTTGGGTGTATGGTTTTAGAGCTAGAAATAGCAAGTTAAAATAAGGCTAGTCCGTTATCAACTTGAAAAAG | 29174 | TGCCACTGAGAACTCTCTTAGTTTTAGAGCTAGAAATAGCAAGTTAAAATAAGGCTA | 29364 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | TGGCACCGAGTCGGTGCcTCGGCCCTTCTCAGTTCGCTAC GACCCATACACCCAAagga | | GTCCGTTATCAACTTGAAAAAGTGGCACC GAGTCGGTGC | |
| 318 | SpyCas9-NG | - | AAGCCTGTGGTTTTGGTCTTGTTTTAGAGCTAGAAATAGC AAGTTAAAATAAGGCTAGTCCGTTATCAACTTGAAAAAG TGGCACCGAGTCGGTGCcGAGGTATTGTGGCAGCAAAG TTCCTAAGACCAAAACcaca | 29175 | TGGAATCAGCCAAAATCTTAGTTTTAGAG CTAGAAATAGCAAGTTAAAATAAGGCTA GTCCGTTATCAACTTGAAAAAGTGGCACC GAGTCGGTGC | 29365 |
| 322 | SpyCas9-SpRY | + | CTCAATCCTTTGGGTGTATGGTTTTAGAGCTAGAAATAGC AAGTTAAAATAAGGCTAGTCCGTTATCAACTTGAAAAAG TGGCACCGAGTCGGTGCcTCGGCCCTTCTCAGTTCGCTAC GACCCATACACCCAAagga | 29176 | AGAACTCTCTTAAGACTACCGTTTTAGAG CTAGAAATAGCAAGTTAAAATAAGGCTA GTCCGTTATCAACTTGAAAAAGTGGCACC GAGTCGGTGC | 29366 |
| 328 | SauCas9 | - | acTCAAGCCTGTGGTTTTGGTCTGTTTTAGTACTCTGGAAA CAGAATCTACTAAAACAAGGCAAAATGCCGTGTTTATCT CGTCAACTTGTTGGCGAGACGAGGTATTGTGGCAGCAAA GTTCCTAAGACCAAAACCacag | 29177 | gaATCAGCCAAAATCTTAAGCTGGTTTTAG TACTCTGGAAACAGAATCTACTAAAACAA GGCAAAATGCCGTGTTTATCTCGTCAACT TGTTGGCGAGA | 29367 |
| 329 | SauCas9KKH | - | TCAAGCCTGTGGTTTTGGTCTGTTTTAGTACTCTGGAAAC AGAATCTACTAAAACAAGGCAAAATGCCGTGTTTATCTC GTCAACTTGTTGGCGAGACGAGGTATTGTGGCAGCAAAG TTCCTAAGACCAAAACCacag | 29178 | TTAATGGAATCAGCCAAAATCGTTTTAGT ACTCTGGAAACAGAATCTACTAAAACAAG GCAAAATGCCGTGTTTATCTCGTCAACTT GTTGGCGAGA | 29368 |
| 330 | SauriCas9 | - | TCAAGCCTGTGGTTTTGGTCTGTTTTAGTACTCTGGAAAC AGAATCTACTAAAACAAGGCAAAATGCCGTGTTTATCTC GTCAACTTGTTGGCGAGACGAGGTATTGTGGCAGCAAAG TTCCTAAGACCAAAACCacag | 29179 | ATCAGCCAAAATCTTAAGCTGGTTTTAGT ACTCTGGAAACAGAATCTACTAAAACAAG GCAAAATGCCGTGTTTATCTCGTCAACTT GTTGGCGAGA | 29369 |
| 331 | SauriCas9-KKH | - | TCAAGCCTGTGGTTTTGGTCTGTTTTAGTACTCTGGAAAC AGAATCTACTAAAACAAGGCAAAATGCCGTGTTTATCTC GTCAACTTGTTGGCGAGACGAGGTATTGTGGCAGCAAAG TTCCTAAGACCAAAACCacag | 29180 | TAATGGAATCAGCCAAAATCTGTTTTAGT ACTCTGGAAACAGAATCTACTAAAACAAG GCAAAATGCCGTGTTTATCTCGTCAACTT GTTGGCGAGA | 29370 |
| 334 | ScaCas9-Sc++ | + | CCTCAATCCTTTGGGTGTATGTTTTAGAGCTAGAAATAGC AAGTTAAAATAAGGCTAGTCCGTTATCAACTTGAAAAAG TGGCACCGAGTCGGTGCTCGGCCCTTCTCAGTTCGCTACG ACCCATACACCCAAAggat | 29181 | TTAAGACTACCTTTCTCCAAGTTTTAGAGC TAGAAATAGCAAGTTAAAATAAGGCTAGT CCGTTATCAACTTGAAAAAGTGGCACCGA GTCGGTGC | 29371 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 335 | SpyCas9 | + | CCTCAATCCTTTGGGTGTATGTTTTAGAGCTAGAAATAGCAAGTTAAAATAAGGCTAGTCCGTTATCAACTTGAAAAAGTGGCACCGAGTCGGTGCTCGGCCCTTCTCAGTTCGCTACGACCCATACACCCAAAggat | 29182 | TAAGACTACCTTTCTCCAAAGTTTTAGAGCTAGAAATAGCAAGTTAAAATAAGGCTAGTCCGTTATCAACTTGAAAAAGTGGCACCGAGTCGGTGC | 29372 |
| 338 | SpyCas9-SpRY | + | CCTCAATCCTTTGGGTGTATGTTTTAGAGCTAGAAATAGCAAGTTAAAATAAGGCTAGTCCGTTATCAACTTGAAAAAGTGGCACCGAGTCGGTGCTCGGCCCTTCTCAGTTCGCTACGACCCATACACCCAAAggat | 29183 | GAACTCTCTTAAGACTACCTGTTTTAGAGCTAGAAATAGCAAGTTAAAATAAGGCTAGTCCGTTATCAACTTGAAAAAGTGGCACCGAGTCGGTGC | 29373 |
| 341 | ScaCas9-Sc++ | − | CAAGCCTGTGGTTTTGGTCTGTTTTAGAGCTAGAAATAGCAAGTTAAAATAAGGCTAGTCCGTTATCAACTTGAAAAAGTGGCACCGAGTCGGTGCCGAGGTATTGTGGCAGCAAAGTTCCTAAGACCAAAACCacag | 29184 | ATGGAATCAGCCAAAATCTTGTTTTAGAGCTAGAAATAGCAAGTTAAAATAAGGCTAGTCCGTTATCAACTTGAAAAAGTGGCACCGAGTCGGTGC | 29374 |
| 342 | SpyCas9-SpRY | − | CAAGCCTGTGGTTTTGGTCTGTTTTAGAGCTAGAAATAGCAAGTTAAAATAAGGCTAGTCCGTTATCAACTTGAAAAAGTGGCACCGAGTCGGTGCCGAGGTATTGTGGCAGCAAAGTTCCTAAGACCAAAACCacag | 29185 | ATGGAATCAGCCAAAATCTTGTTTTAGAGCTAGAAATAGCAAGTTAAAATAAGGCTAGTCCGTTATCAACTTGAAAAAGTGGCACCGAGTCGGTGC | 29375 |
| 343 | SpyCas9-NG | + | CCTCAATCCTTTGGGTGTATGTTTTAGAGCTAGAAATAGCAAGTTAAAATAAGGCTAGTCCGTTATCAACTTGAAAAAGTGGCACCGAGTCGGTGCTCGGCCCTTCTCAGTTCGCTACGACCCATACACCCAAAggat | 29186 | TGCCACTGAGAACTCTCTTAGTTTTAGAGCTAGAAATAGCAAGTTAAAATAAGGCTAGTCCGTTATCAACTTGAAAAAGTGGCACCGAGTCGGTGC | 29376 |
| 346 | BlatCas9 | + | agaccCTCAATCCTTTGGGTGTATGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTCGGCCCTTCTCAGTTCGCTACGACCCATACACCCAAAggat | 29187 | tgagAACTCTCTTAAGACTACCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29377 |
| 347 | BlatCas9 | + | agaccCTCAATCCTTTGGGTGTATGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTCGGCCCTTCTCAGTTCGCTACGACCCATACACCCAAAggat | 29188 | tgagAACTCTCTTAAGACTACCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29378 |
| 351 | SauCas9KKH | − | CTCAAGCCTGTGGTTTTGGTCGTTTTAGTACTCTGGAAACAGAATCTACTAAAACAAGGCAAAATGCCGTGTTTATCTC | 29189 | TTAATGGAATCAGCCAAAATCGTTTTAGTACTCTGGAAACAGAATCTACTAAAACAAG | 29379 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | GTCAACTTGTTGGCGAGAGAGGTATTGTGGCAGCAAAGT TCCTAAGACCAAAACCAcagg | | GCAAAATGCCGTGTTTATCTCGTCAACTT GTTGGCGAGA | |
| 352 | SauriCas9 | + | GACCTCAATCCTTTGGGTGTAGTTTTAGTACTCTGGAAAC AGAATCTACTAAAACAAGGCAAAATGCCGTGTTTATCTC GTCAACTTGTTGGCGAGACGGCCCTTCTCAGTTCGCTACG ACCCATACACCCAAAGgatt | 29190 | CTTAAGACTACCTTTCTCCAAGTTTTAGTA CTCTGGAAACAGAATCTACTAAAACAAGG CAAAATGCCGTGTTTATCTCGTCAACTTGT TGGCGAGA | 29380 |
| 353 | SauriCas9-KKH | + | GACCTCAATCCTTTGGGTGTAGTTTTAGTACTCTGGAAAC AGAATCTACTAAAACAAGGCAAAATGCCGTGTTTATCTC GTCAACTTGTTGGCGAGACGGCCCTTCTCAGTTCGCTACG ACCCATACACCCAAAGgatt | 29191 | CTTAAGACTACCTTTCTCCAAGTTTTAGTA CTCTGGAAACAGAATCTACTAAAACAAGG CAAAATGCCGTGTTTATCTCGTCAACTTGT TGGCGAGA | 29381 |
| 354 | SauriCas9-KKH | − | CTCAAGCCTGTGGTTTTGGTCGTTTTAGTACTCTGGAAAC AGAATCTACTAAAACAAGGCAAAATGCCGTGTTTATCTC GTCAACTTGTTGGCGAGAGAGGTATTGTGGCAGCAAAGT TCCTAAGACCAAAACCAcagg | 29192 | TAATGGAATCAGCCAAAATCTGTTTTAGT ACTCTGGAAACAGAATCTACTAAAACAAG GCAAAATGCCGTGTTTATCTCGTCAACTT GTTGGCGAGA | 29382 |
| 357 | ScaCas9-Sc++ | + | ACCTCAATCCTTTGGGTGTAGTTTTAGAGCTAGAAATAGC AAGTTAAAATAAGGCTAGTCCGTTATCAACTTGAAAAAG TGGCACCGAGTCGGTGCCGGCCCTTCTCAGTTCGCTACGA CCCATACACCCAAAGgatt | 29193 | TTAAGACTACCTTTCTCCAAGTTTTAGAGC TAGAAATAGCAAGTTAAAATAAGGCTAGT CCGTTATCAACTTGAAAAAGTGGCACCGA GTCGGTGC | 29383 |
| 358 | SpyCas9 | + | ACCTCAATCCTTTGGGTGTAGTTTTAGAGCTAGAAATAGC AAGTTAAAATAAGGCTAGTCCGTTATCAACTTGAAAAAG TGGCACCGAGTCGGTGCCGGCCCTTCTCAGTTCGCTACGA CCCATACACCCAAAGgatt | 29194 | TAAGACTACCTTTCTCCAAAGTTTTAGAG CTAGAAATAGCAAGTTAAAATAAGGCTA GTCCGTTATCAACTTGAAAAAGTGGCACC GAGTCGGTGC | 29384 |
| 361 | SpyCas9-SpRY | + | ACCTCAATCCTTTGGGTGTAGTTTTAGAGCTAGAAATAGC AAGTTAAAATAAGGCTAGTCCGTTATCAACTTGAAAAAG TGGCACCGAGTCGGTGCCGGCCCTTCTCAGTTCGCTACGA CCCATACACCCAAAGgatt | 29195 | AACTCTCTTAAGACTACCTTGTTTTAGAGC TAGAAATAGCAAGTTAAAATAAGGCTAGT CCGTTATCAACTTGAAAAAGTGGCACCGA GTCGGTGC | 29385 |
| 362 | SpyCas9-NG | + | ACCTCAATCCTTTGGGTGTAGTTTTAGAGCTAGAAATAGC AAGTTAAAATAAGGCTAGTCCGTTATCAACTTGAAAAAG TGGCACCGAGTCGGTGCCGGCCCTTCTCAGTTCGCTACGA CCCATACACCCAAAGgatt | 29196 | TAAGACTACCTTTCTCCAAAGTTTTAGAG CTAGAAATAGCAAGTTAAAATAAGGCTA GTCCGTTATCAACTTGAAAAAGTGGCACC GAGTCGGTGC | 29386 |

TABLE 4A-continued

Exemplary template RNA sequences and second nick gRNA spacer sequences
Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 365 | SpyCas9-SpRY | - | TCAAGCCTGTGGTTTTGGTCGTTTTAGAGCTAGAAATAGCAAGTTAAAATAAGGCTAGTCCGTTATCAACTTGAAAAAGTGGCACCGAGTCGGTGCGAGGTATTGTGGCAGCAAAGTTCCTAAGACCAAAACCACagg | 29197 | TGGAATCAGCCAAAATCTTAGTTTTAGAGCTAGAAATAGCAAGTTAAAATAAGGCTAGTCCGTTATCAACTTGAAAAAGTGGCACCGAGTCGGTGC | 29387 |
| 366 | St1Cas9 | - | TCAAGCCTGTGGTTTTGGTCGTCTTTGTACTCTGGTACCAGAAGCTACAAAGATAAGGCTTCATGCCGAAATCAACACCCTGTCATTTTATGGCAGGGTGTTTTGAGGTATTGTGGCAGCAAAGTTCCTAAGACCAAAACCACagg | 29198 | GTGTAAATTACTTACTGTTAGTCTTTGTACTCTGGTACCAGAAGCTACAAAGATAAGGCTTCATGCCGAAATCAACACCCTGTCATTTTATGGCAGGGTGTTTT | 29388 |
| 369 | SauCas9 | + | caAGACCTCAATCCTTTGGGTGTGTTTTAGTACTCTGGAAACAGAATCTACTAAAACAAGGCAAAATGCCGTGTTTATCTCGTCAACTTGTTGGCGAGAGGCCCTTCTCAGTTCGCTACGACCCATACACCCAAAGGattg | 29199 | taAAAAAGAAGTAAAATGCCACTGTTTTAGTACTCTGGAAACAGAATCTACTAAAACAAGGCAAAATGCCGTGTTTATCTCGTCAACTTGTTGGCGAGA | 29389 |
| 370 | SauCas9KKH | + | AGACCTCAATCCTTTGGGTGTGTTTTAGTACTCTGGAAACAGAATCTACTAAAACAAGGCAAAATGCCGTGTTTATCTCGTCAACTTGTTGGCGAGAGGCCCTTCTCAGTTCGCTACGACCCATACACCCAAAGGattg | 29200 | ACTCTCTTAAGACTACCTTTCGTTTTAGTACTCTGGAAACAGAATCTACTAAAACAAGGCAAAATGCCGTGTTTATCTCGTCAACTTGTTGGCGAGA | 29390 |
| 371 | SauCas9 | + | caAGACCTCAATCCTTTGGGTGTGTTTTAGTACTCTGGAAACAGAATCTACTAAAACAAGGCAAAATGCCGTGTTTATCTCGTCAACTTGTTGGCGAGAGGCCCTTCTCAGTTCGCTACGACCCATACACCCAAAGGattg | 29201 | taAAAAAGAAGTAAAATGCCACTGTTTTAGTACTCTGGAAACAGAATCTACTAAAACAAGGCAAAATGCCGTGTTTATCTCGTCAACTTGTTGGCGAGA | 29391 |
| 372 | SauCas9KKH | + | AGACCTCAATCCTTTGGGTGTGTTTTAGTACTCTGGAAACAGAATCTACTAAAACAAGGCAAAATGCCGTGTTTATCTCGTCAACTTGTTGGCGAGAGGCCCTTCTCAGTTCGCTACGACCCATACACCCAAAGGattg | 29202 | ACTCTCTTAAGACTACCTTTCGTTTTAGTACTCTGGAAACAGAATCTACTAAAACAAGGCAAAATGCCGTGTTTATCTCGTCAACTTGTTGGCGAGA | 29392 |
| 375 | SauCas9KKH | - | ACTCAAGCCTGTGGTTTTGGTGTTTTAGTACTCTGGAAACAGAATCTACTAAAACAAGGCAAAATGCCGTGTTTATCTCGTCAACTTGTTGGCGAGAGGTATTGTGGCAGCAAAGTTCCTAAGACCAAAACCACaggc | 29203 | AATCAGCCAAAATCTTAAGCTGTTTTAGTACTCTGGAAACAGAATCTACTAAAACAAGGCAAAATGCCGTGTTTATCTCGTCAACTTGTTGGCGAGA | 29393 |
| 376 | SauriCas9 | + | AGACCTCAATCCTTTGGGTGTGTTTTAGTACTCTGGAAACAGAATCTACTAAAACAAGGCAAAATGCCGTGTTTATCTCGTCAACTTGTTGGCGAGAGGCCCTTCTCAGTTCGCTACGACCCATACACCCAAAGGattg | 29204 | CTTAAGACTACCTTTCTCCAAGTTTTAGTACTCTGGAAACAGAATCTACTAAAACAAGGCAAAATGCCGTGTTTATCTCGTCAACTTGTTGGCGAGA | 29394 |

TABLE 4A-continued

Exemplary template RNA sequences and second nick gRNA spacer sequences

Table 4A provides design of RNA components of gene modifying systems for correcting the pathogenic R408W, mutation in PAH. The gRNA spacers from Table 1A were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 377 | SauriCas9-KKH | + | AGACCTCAATCCTTTGGGTGTGTTTTAGTACTCTGGAAACAGAATCTACTAAAACAAGGCAAAATGCCGTGTTTATCTCGTCAACTTGTTGGCGAGAGGCCCTTCTCAGTTCGCTACGACCCATACACCCAAAGGattg | 29205 | CTTAAGACTACCTTTCTCCAAGTTTTAGTACTCTGGAAACAGAATCTACTAAAACAAGGCAAAATGCCGTGTTTATCTCGTCAACTTGTTGGCGAGA | 29395 |
| 380 | ScaCas9-Sc++ | + | GACCTCAATCCTTTGGGTGTGTTTTAGAGCTAGAAATAGCAAGTTAAAATAAGGCTAGTCCGTTATCAACTTGAAAAAGTGGCACCGAGTCGGTGCGGCCCTTCTCAGTTCGCTACGACCCATACACCCAAAGGattg | 29206 | TTAAGACTACCTTTCTCCAAGTTTTAGAGCTAGAAATAGCAAGTTAAAATAAGGCTAGTCCGTTATCAACTTGAAAAAGTGGCACCGAGTCGGTGC | 29396 |
| 381 | SpyCas9-SpRY | + | GACCTCAATCCTTTGGGTGTGTTTTAGAGCTAGAAATAGCAAGTTAAAATAAGGCTAGTCCGTTATCAACTTGAAAAAGTGGCACCGAGTCGGTGCGGCCCTTCTCAGTTCGCTACGACCCATACACCCAAAGGattg | 29207 | ACTCTCTTAAGACTACCTTTGTTTTAGAGCTAGAAATAGCAAGTTAAAATAAGGCTAGTCCGTTATCAACTTGAAAAAGTGGCACCGAGTCGGTGC | 29397 |
| 382 | SpyCas9-SpRY | - | CTCAAGCCTGTGGTTTTGGTGTTTTAGAGCTAGAAATAGCAAGTTAAAATAAGGCTAGTCCGTTATCAACTTGAAAAAGTGGCACCGAGTCGGTGCAGGTATTGTGGCAGCAAAGTTCCTAAGACCAAAACCACaggc | 29208 | GGAATCAGCCAAAATCTTAAGTTTTAGAGCTAGAAATAGCAAGTTAAAATAAGGCTAGTCCGTTATCAACTTGAAAAAGTGGCACCGAGTCGGTGC | 29398 |

TABLE 4B

Exemplary template RNA sequences and second nick gRNA spacer sequences

Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 1 | Nme2Cas9 | - | tcTTGGGTGGCCTGGCCTTCCAAGGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAgtctgatgtactgtgtgcagtggaagacTCGGAAGGCCaggc | 29399 | gcAGCAGGAAAAGATGGCGCTCATGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29576 |
| 2 | SpyCas9-SpRY | - | GGGTGGCCTGGCCTTCCAAGGTTTTAGAGCTAGAAATAGCAAGTTAAAATAAGGCTAGTCCGTTATCAACTTGAAAAAGTGGCACCGAGTCGGTGCgtctgatgtactgtgtgcagtggaagacTCGGAAGGCCaggc | 29400 | AGGAAAAGATGGCGCTCATTGTTTTAGAGCTAGAAATAGCAAGTTAAAATAAGGCTAGTCCGTTATCAACTTGAAAAAGTGGCACCGAGTCGGTGC | 29577 |
| 3 | BlatCas9 | - | cttgGGTGGCCTGGCCTTCCAAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTgtctgatgtactgtgtgcagtggaagacTCGGAAGGCCaggc | 29401 | agcaGGAAAAGATGGCGCTCATTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29578 |
| 4 | SauCas9KKH | + | CTGTGTGCAGTGGAAGACTTGGTTTTAGTACTCTGGAAACAGAATCTACTAAAACAAGGCAAAATGCCGTGTTTATCTCGTCAACTTGTTGGCGAGAcgggatttcttgggtggcctggccttcCGAGTCTTCCActgc | 29402 | CTGACTCAGTGGTGATGAGCTGTTTTAGTACTCTGGAAACAGAATCTACTAAAACAAGGCAAAATGCCGTGTTTATCTCGTCAACTTGTTGGCGAGA | 29579 |
| 5 | SauriCas9-KKH | + | CTGTGTGCAGTGGAAGACTTGGTTTTAGTACTCTGGAAACAGAATCTACTAAAACAAGGCAAAATGCCGTGTTTATCTCGTCAACTTGTTGGCGAGAcgggatttcttgggtggcctggccttcCGAGTCTTCCActgc | 29403 | TGACTCAGTGGTGATGAGCTTGTTTTAGTACTCTGGAAACAGAATCTACTAAAACAAGGCAAAATGCCGTGTTTATCTCGTCAACTTGTTGGCGAGA | 29580 |
| 8 | SpyCas9-SpRY | + | TGTGTGCAGTGGAAGACTTGGTTTTAGAGCTAGAAATAGCAAGTTAAAATAAGGCTAGTCCGTTATCAACTTGAAAAAGTGGCACCGAGTCGGTGCcgggatttcttgggtggcctggccttcCGAGTCTTCCActgc | 29404 | GGTGATGAGCTTTGAGTTTTGTTTTAGAGCTAGAAATAGCAAGTTAAAATAAGGCTAGTCCGTTATCAACTTGAAAAAGTGGCACCGAGTCGGTGC | 29581 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 10 | SpyCas9-SpRY | - | TGGGTGGCCTGGCCTTCCAAGTTTTAGAGCTAGAAATAGCAAGTTAAAATAAGGCTAGTCCGTTATCAACTTGAAAAAGTGGCACCGAGTCGGTGCtctgatgtactgtgtgcagtggaagacTCGGAAGGCCAggcc | 29405 | GGAAAAGATGGCGCTCATTGGTTTTAGAGCTAGAAATAGCAAGTTAAAATAAGGCTAGTCCGTTATCAACTTGAAAAAGTGGCACCGAGTCGGTGC | 29582 |
| 13 | SauCas9KKH | + | ACTGTGTGCAGTGGAAGACTTGTTTTAGTACTCTGGAAACAGAATCTACTAAAACAAGGCAAAATGCCGTGTTTATCTCGTCAACTTGTTGGCGAGAgggatttcttgggtggcctggccttcCGAGTCTTCCACtgca | 29406 | CTGACTCAGTGGTGATGAGCTGTTTTAGTACTCTGGAAACAGAATCTACTAAAACAAGGCAAAATGCCGTGTTTATCTCGTCAACTTGTTGGCGAGA | 29583 |
| 14 | SpyCas9-NG | - | TTGGGTGGCCTGGCCTTCCAGTTTTAGAGCTAGAAATAGCAAGTTAAAATAAGGCTAGTCCGTTATCAACTTGAAAAAGTGGCACCGAGTCGGTGCctgatgtactgtgtgcagtggaagacTCGGAAGGCCAGgcca | 29407 | GGAAAAGATGGCGCTCATTGGTTTTAGAGCTAGAAATAGCAAGTTAAAATAAGGCTAGTCCGTTATCAACTTGAAAAAGTGGCACCGAGTCGGTGC | 29584 |
| 17 | SpyCas9-NG | + | CTGTGTGCAGTGGAAGACTTGTTTTAGAGCTAGAAATAGCAAGTTAAAATAAGGCTAGTCCGTTATCAACTTGAAAAAGTGGCACCGAGTCGGTGCgggatttcttgggtggcctggccttcCGAGTCTTCCACtgca | 29408 | CTCAGTGGTGATGAGCTTTGGTTTTAGAGCTAGAAATAGCAAGTTAAAATAAGGCTAGTCCGTTATCAACTTGAAAAAGTGGCACCGAGTCGGTGC | 29585 |
| 21 | SpyCas9-SpRY | - | TTGGGTGGCCTGGCCTTCCAGTTTTAGAGCTAGAAATAGCAAGTTAAAATAAGGCTAGTCCGTTATCAACTTGAAAAAGTGGCACCGAGTCGGTGCctgatgtactgtgtgcagtggaagacTCGGAAGGCCAGgcca | 29409 | GAAAAGATGGCGCTCATTGTGTTTTAGAGCTAGAAATAGCAAGTTAAAATAAGGCTAGTCCGTTATCAACTTGAAAAAGTGGCACCGAGTCGGTGC | 29586 |
| 23 | SpyCas9-SpRY | + | CTGTGTGCAGTGGAAGACTTGTTTTAGAGCTAGAAATAGCAAGTTAAAATAAGGCTAGTCCGTTATCAACTTGAAAAAGTGGCACCGAGTCGGTGCgggatttcttgggtggcctggccttcCGAGTCTTCCACtgca | 29410 | GTGATGAGCTTTGAGTTTTCGTTTTAGAGCTAGAAATAGCAAGTTAAAATAAGGCTAGTCCGTTATCAACTTGAAAAAGTGGCACCGAGTCGGTGC | 29587 |
| 29 | SauCas9 | + | tgTACTGTGTGCAGTGGAAGACTGTTTTAGTACTCTGGAAACAGAATCTACTAAAACAAGGCAAAATGCCGTGTTTATCTCGTCAACTTGTTGGCGAGAggatttcttgggtggcctggccttcCGAGTCTTCCACTgcac | 29411 | ctCTGACTCAGTGGTGATGAGCTGTTTTAGTACTCTGGAAACAGAATCTACTAAAACAAGGCAAAATGCCGTGTTTATCTCGTCAACTTGTTGGCGAGA | 29588 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 30 | SauCas9KKH | + | TACTGTGTGCAGTGGAAGACTGTTTTAGTACTCTGGAAACAGAATCTACTAAAACAAGGCAAAATGCCGTGTTTATCTCGTCAACTTGTTGGCGAGAggatttcttgggtggcctggccttcCGAGTCTTCCACTgcac | 29412 | CTGACTCAGTGGTGATGAGCTGTTTTAGTACTCTGGAAACAGAATCTACTAAAACAAGGCAAAATGCCGTGTTTATCTCGTCAACTTGTTGGCGAGA | 29589 |
| 33 | ScaCas9-Sc++ | - | CTTGGGTGGCCTGGCCTTCCGTTTTAGAGCTAGAAATAGCAAGTTAAAATAAGGCTAGTCCGTTATCAACTTGAAAAAGTGGCACCGAGTCGGTGCtgatgtactgtgtgcagtggaagacTCGGAAGGCCAGGccac | 29413 | AAAGATGGCGCTCATTGTGCGTTTTAGAGCTAGAAATAGCAAGTTAAAATAAGGCTAGTCCGTTATCAACTTGAAAAAGTGGCACCGAGTCGGTGC | 29590 |
| 34 | SpyCas9-SpRY | - | CTTGGGTGGCCTGGCCTTCCGTTTTAGAGCTAGAAATAGCAAGTTAAAATAAGGCTAGTCCGTTATCAACTTGAAAAAGTGGCACCGAGTCGGTGCtgatgtactgtgtgcagtggaagacTCGGAAGGCCAGGccac | 29414 | AAAAGATGGCGCTCATTGTGGTTTTAGAGCTAGAAATAGCAAGTTAAAATAAGGCTAGTCCGTTATCAACTTGAAAAAGTGGCACCGAGTCGGTGC | 29591 |
| 37 | ScaCas9-Sc++ | - | ACTGTGTGCAGTGGAAGACTGTTTTAGAGCTAGAAATAGCAAGTTAAAATAAGGCTAGTCCGTTATCAACTTGAAAAAGTGGCACCGAGTCGGTGCggatttcttgggtggcctggccttcCGAGTCTTCCACTgcac | 29415 | ACTCAGTGGTGATGAGCTTTGTTTTAGAGCTAGAAATAGCAAGTTAAAATAAGGCTAGTCCGTTATCAACTTGAAAAAGTGGCACCGAGTCGGTGC | 29592 |
| 38 | SpyCas9 | + | ACTGTGTGCAGTGGAAGACTGTTTTAGAGCTAGAAATAGCAAGTTAAAATAAGGCTAGTCCGTTATCAACTTGAAAAAGTGGCACCGAGTCGGTGCggatttcttgggtggcctggccttcCGAGTCTTCCACTgcac | 29416 | TCCTAGTGCCTCTGACTCAGGTTTTAGAGCTAGAAATAGCAAGTTAAAATAAGGCTAGTCCGTTATCAACTTGAAAAAGTGGCACCGAGTCGGTGC | 29593 |
| 41 | SpyCas9-SpRY | + | ACTGTGTGCAGTGGAAGACTGTTTTAGAGCTAGAAATAGCAAGTTAAAATAAGGCTAGTCCGTTATCAACTTGAAAAAGTGGCACCGAGTCGGTGCggatttcttgggtggcctggccttcCGAGTCTTCCACTgcac | 29417 | TGATGAGCTTTGAGTTTTCTGTTTTAGAGCTAGAAATAGCAAGTTAAAATAAGGCTAGTCCGTTATCAACTTGAAAAAGTGGCACCGAGTCGGTGC | 29594 |

TABLE 4B-continued

Exemplary template RNA sequences and second nick gRNA spacer sequences

Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 42 | SpyCas9-NG | + | ACTGTGTGCAGTGGAAGACTGTTTTAGAGCTAGAAATAGCAAGTTAAAATAAGGCTAGTCCGTTATCAACTTGAAAAAGTGGCACCGAGTCGGTGCggatttcttgggtggcctggccttcCGAGTCTTCCACTgcac | 29418 | CTCAGTGGTGATGAGCTTTGGTTTTAGAGCTAGAAATAGCAAGTTAAAATAAGGCTAGTCCGTTATCAACTTGAAAAAGTGGCACCGAGTCGGTGC | 29595 |
| 45 | BlatCas9 | - | tttcTTGGGTGGCCTGGCCTTCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTgatgtactgtgtgcagtggaagacTCGGAAGGCCAGGccac | 29419 | ggaaAAGATGGCGCTCATTGTGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29596 |
| 51 | SauCas9 | + | atGTACTGTGTGCAGTGGAAGACGTTTTAGTACTCTGGAAACAGAATCTACTAAAACAAGGCAAAATGCCGTGTTTATCTCGTCAACTTGTTGGCGAGAgatttcttgggtggcctggccttcCGAGTCTTCCACTGcaca | 29420 | ctCTGACTCAGTGGTGATGAGCTGTTTTAGTACTCTGGAAACAGAATCTACTAAAACAAGGCAAAATGCCGTGTTTATCTCGTCAACTTGTTGGCGAGA | 29597 |
| 52 | SauCas9KKH | + | GTACTGTGTGCAGTGGAAGACGTTTTAGTACTCTGGAAACAGAATCTACTAAAACAAGGCAAAATGCCGTGTTTATCTCGTCAACTTGTTGGCGAGAgatttcttgggtggcctggccttcCGAGTCTTCCACTGcaca | 29421 | AGTTTTCTTTCTTCTTTTCATGTTTTAGTACTCTGGAAACAGAATCTACTAAAACAAGGCAAAATGCCGTGTTTATCTCGTCAACTTGTTGGCGAGA | 29598 |
| 53 | SauriCas9 | + | GTACTGTGTGCAGTGGAAGACGTTTTAGTACTCTGGAAACAGAATCTACTAAAACAAGGCAAAATGCCGTGTTTATCTCGTCAACTTGTTGGCGAGAgatttcttgggtggcctggccttcCGAGTCTTCCACTGcaca | 29422 | TTCTTTTCATCCCAGCTTGCAGTTTTAGTACTCTGGAAACAGAATCTACTAAAACAAGGCAAAATGCCGTGTTTATCTCGTCAACTTGTTGGCGAGA | 29599 |
| 54 | SauriCas9-KKH | + | GTACTGTGTGCAGTGGAAGACGTTTTAGTACTCTGGAAACAGAATCTACTAAAACAAGGCAAAATGCCGTGTTTATCTCGTCAACTTGTTGGCGAGAgatttcttgggtggcctggccttcCGAGTCTTCCACTGcaca | 29423 | TGACTCAGTGGTGATGAGCTTGTTTTAGTACTCTGGAAACAGAATCTACTAAAACAAGGCAAAATGCCGTGTTTATCTCGTCAACTTGTTGGCGAGA | 29600 |
| 55 | SauriCas9-KKH | - | TTCTTGGGTGGCCTGGCCTTCGTTTTAGTACTCTGGAAACAGAATCTACTAAAACAAGGCAAAATGCCGTGTTTATCTCGTCAACTTGTTGG | 29424 | AAAAGATGGCGCTCATTGTGCGTTTTAGTACTCTGGAAACAGAATCTACTAAAACAAGGCAAAATGCCGTGTTTATCTCGTCAACTTGTTGGCGAGA | 29601 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | CGAGAgatgtactgtgtgcagtggaagacTCGGAAGGCCAGGCcacc | | | |
| 60 | ScaCas9-Sc++ | + | TACTGTGTGCAGTGGAAGACGTTTTAGAGCTAGAAATAGCAAGTTAAAATAAGGCTAGTCCGTTATCAACTTGAAAAAGTGGCACCGAGTCGGTGCgatttcttgggtggcctggccttcCGAGTCTTCCACTGcaca | 29425 | ACTCAGTGGTGATGAGCTTTGTTTTAGAGCTAGAAATAGCAAGTTAAAATAAGGCTAGTCCGTTATCAACTTGAAAAAGTGGCACCGAGTCGGTGC | 29602 |
| 61 | SpyCas9-SpRY | + | TACTGTGTGCAGTGGAAGACGTTTTAGAGCTAGAAATAGCAAGTTAAAATAAGGCTAGTCCGTTATCAACTTGAAAAAGTGGCACCGAGTCGGTGCgatttcttgggtggcctggccttcCGAGTCTTCCACTGcaca | 29426 | GATGAGCTTTGAGTTTTCTTGTTTTAGAGCTAGAAATAGCAAGTTAAAATAAGGCTAGTCCGTTATCAACTTGAAAAAGTGGCACCGAGTCGGTGC | 29603 |
| 62 | SpyCas9-SpRY | - | TCTTGGGTGGCCTGGCCTTCGTTTTAGAGCTAGAAATAGCAAGTTAAAATAAGGCTAGTCCGTTATCAACTTGAAAAAGTGGCACCGAGTCGGTGCgatgtactgtgtgcagtggaagacTCGGAAGGCCAGGCcacc | 29427 | AAAGATGGCGCTCATTGTGCGTTTTAGAGCTAGAAATAGCAAGTTAAAATAAGGCTAGTCCGTTATCAACTTGAAAAAGTGGCACCGAGTCGGTGC | 29604 |
| 65 | SauCas9KKH | - | TTTCTTGGGTGGCCTGGCCTTGTTTTAGTACTCTGGAAACAGAATCTACTAAAACAAGGCAAAATGCCGTGTTTATCTCGTCAACTTGTTGGCGAGAatgtactgtgtgcagtggaagacTCGGAAGGCCAGGCCaccc | 29428 | AAGATGGCGCTCATTGTGCCTGTTTTAGTACTCTGGAAACAGAATCTACTAAAACAAGGCAAAATGCCGTGTTTATCTCGTCAACTTGTTGGCGAGA | 29605 |
| 66 | SauCas9KKH | + | TGTACTGTGTGCAGTGGAAGAGTTTTAGTACTCTGGAAACAGAATCTACTAAAACAAGGCAAAATGCCGTGTTTATCTCGTCAACTTGTTGGCGAGAatttcttgggtggcctggccttcCGAGTCTTCCACTGCacac | 29429 | AGTTTTCTTTCTTCTTTTCATGTTTTAGTACTCTGGAAACAGAATCTACTAAAACAAGGCAAAATGCCGTGTTTATCTCGTCAACTTGTTGGCGAGA | 29606 |
| 67 | SauCas9KKH | - | TTTCTTGGGTGGCCTGGCCTTGTTTTAGTACTCTGGAAACAGAATCTACTAAAACAAGGCAAAATGCCGTGTTTATCTCGTCAACTTGTTGGCGAGAatgtactgtgtgcagtggaagacTCGGAAGGCCAGGCCaccc | 29430 | AAGATGGCGCTCATTGTGCCTGTTTTAGTACTCTGGAAACAGAATCTACTAAAACAAGGCAAAATGCCGTGTTTATCTCGTCAACTTGTTGGCGAGA | 29607 |
| 70 | SpyCas9-SpRY | + | GTACTGTGTGCAGTGGAAGAGTTTTAGAGCTAGAAATAGCAAGTTAAAATAAGGCTAGTC | 29431 | ATGAGCTTTGAGTTTTCTTTGTTTTAGAGCTAGAAATAGCAAGTTAAAATAAGGCTAGTCCGTTATCAACTTGAA | 29608 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | CGTTATCAACTTGAAAAAGTGGCACCGAGT CGGTGCatttcttgggtggcctggccttcCGAGTCTTCCA CTGCacac | | AAAGTGGCACCGAGTCGGTGC | |
| 71 | SpyCas9-SpRY | - | TTCTTGGGTGGCCTGGCCTTGTTTTAGAGCT AGAAATAGCAAGTTAAAATAAGGCTAGTCC GTTATCAACTTGAAAAAGTGGCACCGAGTC GGTGCatgtactgtgtgcagtggaagacTCGGAAGGCCA GGCCaccc | 29432 | AAGATGGCGCTCATTGTGCCGTTTTAGAGCTAGAAAT AGCAAGTTAAAATAAGGCTAGTCCGTTATCAACTTGA AAAAGTGGCACCGAGTCGGTGC | 29609 |
| 73 | SauCas9KKH | - | ATTTCTTGGGTGGCCTGGCCTGTTTTAGTAC TCTGGAAACAGAATCTACTAAAACAAGGCA AAATGCCGTGTTTATCTCGTCAACTTGTTGG CGAGAtgtactgtgtgcagtggaagacTCGGAAGGCCA GGCCAccca | 29433 | AAGATGGCGCTCATTGTGCCTGTTTTAGTACTCTGGA AACAGAATCTACTAAAACAAGGCAAAATGCCGTGTTT ATCTCGTCAACTTGTTGGCGAGA | 29610 |
| 74 | SpyCas9-SpRY | + | TGTACTGTGTGCAGTGGAAGGTTTTAGAGC TAGAAATAGCAAGTTAAAATAAGGCTAGTC CGTTATCAACTTGAAAAAGTGGCACCGAGT CGGTGCtttcttgggtggcctggccttcCGAGTCTTCCAC TGCAcaca | 29434 | TGAGCTTTGAGTTTTCTTTCGTTTTAGAGCTAGAAATA GCAAGTTAAAATAAGGCTAGTCCGTTATCAACTTGAA AAAGTGGCACCGAGTCGGTGC | 29611 |
| 75 | SpyCas9-SpRY | - | TTTCTTGGGTGGCCTGGCCTGTTTTAGAGCT AGAAATAGCAAGTTAAAATAAGGCTAGTCC GTTATCAACTTGAAAAAGTGGCACCGAGTC GGTGCtgtactgtgtgcagtggaagacTCGGAAGGCCA GGCCAccca | 29435 | AGATGGCGCTCATTGTGCCTGTTTTAGAGCTAGAAAT AGCAAGTTAAAATAAGGCTAGTCCGTTATCAACTTGA AAAAGTGGCACCGAGTCGGTGC | 29612 |
| 78 | SpyCas9-SpRY | + | ATGTACTGTGTGCAGTGGAAGTTTTAGAGC TAGAAATAGCAAGTTAAAATAAGGCTAGTC CGTTATCAACTTGAAAAAGTGGCACCGAGT CGGTGCttcttgggtggcctggccttcCGAGTCTTCCAC TGCACacag | 29436 | GAGCTTTGAGTTTTCTTTCTGTTTTAGAGCTAGAAATA GCAAGTTAAAATAAGGCTAGTCCGTTATCAACTTGAA AAAGTGGCACCGAGTCGGTGC | 29613 |
| 79 | SpyCas9-SpRY | - | ATTTCTTGGGTGGCCTGGCCGTTTTAGAGCT AGAAATAGCAAGTTAAAATAAGGCTAGTCC GTTATCAACTTGAAAAAGTGGCACCGAGTC GGTGCgtactgtgtgcagtggaagacTCGGAAGGCCAG GCCACccaa | 29437 | GATGGCGCTCATTGTGCCTGGTTTTAGAGCTAGAAAT AGCAAGTTAAAATAAGGCTAGTCCGTTATCAACTTGA AAAAGTGGCACCGAGTCGGTGC | 29614 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 81 | SpyCas9-NG | + | GATGTACTGTGTGCAGTGGAGTTTTAGAGCTAGAAATAGCAAGTTAAAATAAGGCTAGTCCGTTATCAACTTGAAAAAGTGGCACCGAGTCGGTGCtcttgggtggcctggccttcCGAGTCTTCCACTGCACAcagt | 29438 | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGC | 29615 |
| 85 | SpyCas9-SpRY | + | GATGTACTGTGTGCAGTGGAGTTTTAGAGCTAGAAATAGCAAGTTAAAATAAGGCTAGTCCGTTATCAACTTGAAAAAGTGGCACCGAGTCGGTGCtcttgggtggcctggccttcCGAGTCTTCCACTGCACAcagt | 29439 | AGCTTTGAGTTTTCTTTCTTGTTTTAGAGCTAGAAATAGCAAGTTAAAATAAGGCTAGTCCGTTATCAACTTGAAAAAGTGGCACCGAGTCGGTGC | 29616 |
| 86 | SpyCas9-SpRY | - | GATTTCTTGGGTGGCCTGGCGTTTTAGAGCTAGAAATAGCAAGTTAAAATAAGGCTAGTCCGTTATCAACTTGAAAAAGTGGCACCGAGTCGGTGCtactgtgtgcagtggaagacTCGGAAGGCCAGGCCACCcaag | 29440 | ATGGCGCTCATTGTGCCTGGGTTTTAGAGCTAGAAATAGCAAGTTAAAATAAGGCTAGTCCGTTATCAACTTGAAAAAGTGGCACCGAGTCGGTGC | 29617 |
| 87 | BlatCas9 | - | cgggATTTCTTGGGTGGCCTGGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTactgtgtgcagtggaagacTCGGAAGGCCAGGCCACCcaag | 29441 | aaagATGGCGCTCATTGTGCCTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29618 |
| 88 | BlatCas9 | - | cgggATTTCTTGGGTGGCCTGGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTactgtgtgcagtggaagacTCGGAAGGCCAGGCCACCcaag | 29442 | aaagATGGCGCTCATTGTGCCTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29619 |
| 91 | Nme2Cas9 | - | ctCGGGATTTCTTGGGTGGCCTGGGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAactgtgtgcagtggaagacTCGGAAGGCCAGGCCACCCaaga | 29443 | gcAGCAGGAAAAGATGGCGCTCATGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29620 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 94 | ScaCas9-Sc++ | + | TGATGTACTGTGTGCAGTGGGTTTTAGAGCTAGAAATAGCAAGTTAAAATAAGGCTAGTCCGTTATCAACTTGAAAAAGTGGCACCGAGTCGGTGCcttgggtggcctggccttcCGAGTCTTCCACTGCACACagta | 29444 | TTTCTTTCTTCTTTTCATCCGTTTTAGAGCTAGAAATAGCAAGTTAAAATAAGGCTAGTCCGTTATCAACTTGAAAAAGTGGCACCGAGTCGGTGC | 29621 |
| 95 | SpyCas9-SpRY | + | TGATGTACTGTGTGCAGTGGGTTTTAGAGCTAGAAATAGCAAGTTAAAATAAGGCTAGTCCGTTATCAACTTGAAAAAGTGGCACCGAGTCGGTGCcttgggtggcctggccttcCGAGTCTTCCACTGCACACagta | 29445 | GCTTTGAGTTTTCTTTCTTCGTTTTAGAGCTAGAAATAGCAAGTTAAAATAAGGCTAGTCCGTTATCAACTTGAAAAAGTGGCACCGAGTCGGTGC | 29622 |
| 96 | SpyCas9-SpRY | - | GGATTTCTTGGGTGGCCTGGGTTTTAGAGCTAGAAATAGCAAGTTAAAATAAGGCTAGTCCGTTATCAACTTGAAAAAGTGGCACCGAGTCGGTGCactgtgtgcagtggaagacTCGGAAGGCCAGGCCACCCaaga | 29446 | TGGCGCTCATTGTGCCTGGCGTTTTAGAGCTAGAAATAGCAAGTTAAAATAAGGCTAGTCCGTTATCAACTTGAAAAAGTGGCACCGAGTCGGTGC | 29623 |
| 97 | BlatCas9 | + | gtctGATGTACTGTGTGCAGTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcttgggtggcctggccttcCGAGTCTTCCACTGCACACagta | 29447 | tgagCTTTGAGTTTTCTTTCTTCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29624 |
| 98 | BlatCas9 | - | tcggGATTTCTTGGGTGGCCTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTactgtgtgcagtggaagacTCGGAAGGCCAGGCCACCCaaga | 29448 | aaagATGGCGCTCATTGTGCCTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29625 |
| 99 | BlatCas9 | - | tcggGATTTCTTGGGTGGCCTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTactgtgtgcagtggaagacTCGGAAGGCCAGGCCACCCaaga | 29449 | aaagATGGCGCTCATTGTGCCTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29626 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 100 | BlatCas9 | + | gtctGATGTACTGTGTGCAGTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcttgggtggcctggccttcCGAGTCTTCCACTGCACACagta | 29450 | tgagCTTTGAGTTTTCTTTCTTCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29627 |
| 101 | BlatCas9 | - | tcggGATTTCTTGGGTGGCCTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTActgtgtgcagtggaagactCTGGAAGGCCAGGCCACCCaaga | 29451 | aaagATGGCGCTCATTGTGCCTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29628 |
| 106 | SauCas9KKH | + | TCTGATGTACTGTGTGCAGTGGTTTTAGTACTCTGGAAACAGAATCTACTAAAACAAGGCAAAATGCCGTGTTTATCTCGTCAACTTGTTGGCGAGAttgggtggcctggccttcCGAGTCTTCCACTGCACACAgtac | 29452 | AGTTTTCTTTCTTCTTTTCATGTTTTAGTACTCTGGAAACAGAATCTACTAAAACAAGGCAAAATGCCGTGTTTATCTCGTCAACTTGTTGGCGAGA | 29629 |
| 107 | SauriCas9-KKH | + | TCTGATGTACTGTGTGCAGTGGTTTTAGTACTCTGGAAACAGAATCTACTAAAACAAGGCAAAATGCCGTGTTTATCTCGTCAACTTGTTGGCGAGAttgggtggcctggccttcCGAGTCTTCCACTGCACACAgtac | 29453 | GTTTTCTTTCTTCTTTTCATCGTTTTAGTACTCTGGAAACAGAATCTACTAAAACAAGGCAAAATGCCGTGTTTATCTCGTCAACTTGTTGGCGAGA | 29630 |
| 110 | SpyCas9-SpRY | + | CTGATGTACTGTGTGCAGTGGTTTTAGAGCTAGAAATAGCAAGTTAAAATAAGGCTAGTCCGTTATCAACTTGAAAAAGTGGCACCGAGTCGGTGCttgggtggcctggccttcCGAGTCTTCCACTGCACACAgtac | 29454 | CTTTGAGTTTTCTTTCTTCTGTTTTAGAGCTAGAAATAGCAAGTTAAAATAAGGCTAGTCCGTTATCAACTTGAAAAAGTGGCACCGAGTCGGTGC | 29631 |
| 112 | SpyCas9-SpRY | - | GGGATTTCTTGGGTGGCCTGGTTTTAGAGCTAGAAATAGCAAGTTAAAATAAGGCTAGTCCGTTATCAACTTGAAAAAGTGGCACCGAGTCGGTGCctgtgtgcagtggaagactCGGAAGGCCAGGCCACCCAagaa | 29455 | GGCGCTCATTGTGCCTGGCAGTTTTAGAGCTAGAAATAGCAAGTTAAAATAAGGCTAGTCCGTTATCAACTTGAAAAAGTGGCACCGAGTCGGTGC | 29632 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 115 | SauCas9KKH | + | GTCTGATGTACTGTGTGCAGTGTTTTAGTACTCTGGAAACAGAATCTACTAAAACAAGGCAAAATGCCGTGTTTATCTCGTCAACTTGTTGGCGAGAtgggtggcctggccttcCGAGTCTTCCACTGCACACAGtaca | 29456 | AGTTTTCTTTCTTCTTTTCATGTTTTAGTACTCTGGAAACAGAATCTACTAAAACAAGGCAAAATGCCGTGTTTATCTCGTCAACTTGTTGGCGAGA | 29633 |
| 116 | SpyCas9-NG | + | TCTGATGTACTGTGTGCAGTGTTTTAGAGCTAGAAATAGCAAGTTAAAATAAGGCTAGTCCGTTATCAACTTGAAAAAGTGGCACCGAGTCGGTGCtgggtggcctggccttcCGAGTCTTCCACTGCACACAGtaca | 29457 | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGC | 29634 |
| 119 | SpyCas9-NG | - | CGGGATTTCTTGGGTGGCCTGTTTTAGAGCTAGAAATAGCAAGTTAAAATAAGGCTAGTCCGTTATCAACTTGAAAAAGTGGCACCGAGTCGGTGCtgtgtgcagtggaagacTCGGAAGGCCAGGCCACCCAAgaaa | 29458 | CGCTCATTGTGCCTGGCAACGTTTTAGAGCTAGAAATAGCAAGTTAAAATAAGGCTAGTCCGTTATCAACTTGAAAAAGTGGCACCGAGTCGGTGC | 29635 |
| 123 | SpyCas9-SpRY | + | TCTGATGTACTGTGTGCAGTGTTTTAGAGCTAGAAATAGCAAGTTAAAATAAGGCTAGTCCGTTATCAACTTGAAAAAGTGGCACCGAGTCGGTGCtgggtggcctggccttcCGAGTCTTCCACTGCACACAGtaca | 29459 | TTTGAGTTTTCTTTCTTCTTGTTTTAGAGCTAGAAATAGCAAGTTAAAATAAGGCTAGTCCGTTATCAACTTGAAAAAGTGGCACCGAGTCGGTGC | 29636 |
| 125 | SpyCas9-SpRY | - | CGGGATTTCTTGGGTGGCCTGTTTTAGAGCTAGAAATAGCAAGTTAAAATAAGGCTAGTCCGTTATCAACTTGAAAAAGTGGCACCGAGTCGGTGCtgtgtgcagtggaagacTCGGAAGGCCAGGCCACCCAAgaaa | 29460 | GCGCTCATTGTGCCTGGCAAGTTTTAGAGCTAGAAATAGCAAGTTAAAATAAGGCTAGTCCGTTATCAACTTGAAAAAGTGGCACCGAGTCGGTGC | 29637 |
| 132 | SauCas9 | + | caTGTCTGATGTACTGTGTGCAGGTTTTAGTACTCTGGAAACAGAATCTACTAAAACAAGGCAAAATGCCGTGTTTATCTCGTCAACTTGTTGGCGAGAgggtggcctggccttcCGAGTCTTCCACTGCACACAGTacat | 29461 | ctCTGACTCAGTGGTGATGAGCTGTTTTAGTACTCTGGAAACAGAATCTACTAAAACAAGGCAAAATGCCGTGTTTATCTCGTCAACTTGTTGGCGAGA | 29638 |
| 133 | SauCas9KKH | + | TGTCTGATGTACTGTGTGCAGGTTTTAGTACTCTGGAAACAGAATCTACTAAAACAAGGCAAAATGCCGTGTTTATCTCGTCAACTTGTTGGCGAGAgggtggcctggccttcCGAGTCTTCCACTGCACACAGTacat | 29462 | AGTTTTCTTTCTTCTTTTCATGTTTTAGTACTCTGGAAACAGAATCTACTAAAACAAGGCAAAATGCCGTGTTTATCTCGTCAACTTGTTGGCGAGA | 29639 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 136 | ScaCas9-Sc++ | + | GTCTGATGTACTGTGTGCAGGTTTTAGAGCTAGAAATAGCAAGTTAAAATAAGGCTAGTCCGTTATCAACTTGAAAAAGTGGCACCGAGTCGGTGCgggtggcctggccttcCGAGTCTTCCACTGCACACAGTacat | 29463 | TTTCTTTCTTCTTTTCATCCGTTTTAGAGCTAGAAATAGCAAGTTAAAATAAGGCTAGTCCGTTATCAACTTGAAAAAGTGGCACCGAGTCGGTGC | 29640 |
| 137 | SpyCas9 | + | GTCTGATGTACTGTGTGCAGGTTTTAGAGCTAGAAATAGCAAGTTAAAATAAGGCTAGTCCGTTATCAACTTGAAAAAGTGGCACCGAGTCGGTGCgggtggcctggccttcCGAGTCTTCCACTGCACACAGTacat | 29464 | CTTTTCATCCCAGCTTGCACGTTTTAGAGCTAGAAATAGCAAGTTAAAATAAGGCTAGTCCGTTATCAACTTGAAAAAGTGGCACCGAGTCGGTGC | 29641 |
| 140 | SpyCas9-SpRY | + | GTCTGATGTACTGTGTGCAGGTTTTAGAGCTAGAAATAGCAAGTTAAAATAAGGCTAGTCCGTTATCAACTTGAAAAAGTGGCACCGAGTCGGTGCgggtggcctggccttcCGAGTCTTCCACTGCACACAGTacat | 29465 | TTGAGTTTTCTTTCTTCTTTGTTTTAGAGCTAGAAATAGCAAGTTAAAATAAGGCTAGTCCGTTATCAACTTGAAAAAGTGGCACCGAGTCGGTGC | 29642 |
| 143 | ScaCas9-Sc++ | - | TCGGGATTTCTTGGGTGGCCGTTTTAGAGCTAGAAATAGCAAGTTAAAATAAGGCTAGTCCGTTATCAACTTGAAAAAGTGGCACCGAGTCGGTGCgtgtgcagtggaagacTCGGAAGGCCAGGCCACCCAAGaaat | 29466 | CGCTCATTGTGCCTGGCAACGTTTTAGAGCTAGAAATAGCAAGTTAAAATAAGGCTAGTCCGTTATCAACTTGAAAAAGTGGCACCGAGTCGGTGC | 29643 |
| 144 | SpyCas9 | - | TCGGGATTTCTTGGGTGGCCGTTTTAGAGCTAGAAATAGCAAGTTAAAATAAGGCTAGTCCGTTATCAACTTGAAAAAGTGGCACCGAGTCGGTGCgtgtgcagtggaagacTCGGAAGGCCAGGCCACCCAAGaaat | 29467 | CGCTCATTGTGCCTGGCAACGTTTTAGAGCTAGAAATAGCAAGTTAAAATAAGGCTAGTCCGTTATCAACTTGAAAAAGTGGCACCGAGTCGGTGC | 29644 |
| 147 | SpyCas9-SpRY | - | TCGGGATTTCTTGGGTGGCCGTTTTAGAGCTAGAAATAGCAAGTTAAAATAAGGCTAGTCCGTTATCAACTTGAAAAAGTGGCACCGAGTCGGTGCgtgtgcagtggaagacTCGGAAGGCCAGGCCACCCAAGaaat | 29468 | CGCTCATTGTGCCTGGCAACGTTTTAGAGCTAGAAATAGCAAGTTAAAATAAGGCTAGTCCGTTATCAACTTGAAAAAGTGGCACCGAGTCGGTGC | 29645 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 148 | SpyCas9-NG | + | GTCTGATGTACTGTGTGCAGGTTTTAGAGCTAGAAATAGCAAGTTAAAATAAGGCTAGTCCGTTATCAACTTGAAAAAGTGGCACCGAGTCGGTGCgggtggcctggccttcCGAGTCTTCCACTGCACACAGTacat | 29469 | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGC | 29646 |
| 151 | SpyCas9-NG | - | TCGGGATTTCTTGGGTGGCCGTTTTAGAGCTAGAAATAGCAAGTTAAAATAAGGCTAGTCCGTTATCAACTTGAAAAAGTGGCACCGAGTCGGTGCgtgtgcagtggaagacTCGGAAGGCCAGGCCACCCAAGaaat | 29470 | CGCTCATTGTGCCTGGCAACGTTTTAGAGCTAGAAATAGCAAGTTAAAATAAGGCTAGTCCGTTATCAACTTGAAAAAGTGGCACCGAGTCGGTGC | 29647 |
| 154 | BlatCas9 | - | ctctCGGGATTTCTTGGGTGGCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTgtgtgcagtggaagacTCGGAAGGCCAGGCCACCCAAGaaat | 29471 | gcgcTCATTGTGCCTGGCAACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29648 |
| 160 | Nme2Cas9 | - | tcCTCTCGGGATTTCTTGGGTGGCGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAtgtgcagtggaagacTCGGAAGGCCAGGCCACCCAAGAaatc | 29472 | gcAGCAGGAAAAGATGGCGCTCATGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29649 |
| 161 | SauCas9 | + | ccATGTCTGATGTACTGTGTGCAGTTTTAGTACTCTGGAAACAGAATCTACTAAAACAAGGCAAAATGCCGTGTTTATCTCGTCAACTTGTTGGCGAGAggtggcctggccttcCGAGTCTTCCACTGCACACAGTAcatc | 29473 | ctCTGACTCAGTGGTGATGAGCTGTTTTAGTACTCTGGAAACAGAATCTACTAAAACAAGGCAAAATGCCGTGTTTATCTCGTCAACTTGTTGGCGAGA | 29650 |
| 162 | SauCas9KKH | + | ATGTCTGATGTACTGTGTGCAGTTTTAGTACTCTGGAAACAGAATCTACTAAAACAAGGCAAAATGCCGTGTTTATCTCGTCAACTTGTTGGCGAGAggtggcctggccttcCGAGTCTTCCACTGCACACAGTAcatc | 29474 | AGTTTTCTTTCTTCTTTTCATGTTTTAGTACTCTGGAAACAGAATCTACTAAAACAAGGCAAAATGCCGTGTTTATCTCGTCAACTTGTTGGCGAGA | 29651 |
| 163 | SauriCas9 | + | ATGTCTGATGTACTGTGTGCAGTTTTAGTACTCTGGAAACAGAATCTACTAAAACAAGGCA | 29475 | TTCTTTTCATCCCAGCTTGCAGTTTTAGTACTCTGGAAACAGAATCTACTAAAACAAGGCAAAATGCCGTGTTTA | 29652 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | AAATGCCGTGTTTATCTCGTCAACTTGTTGG CGAGAggtggcctggccttcCGAGTCTTCCACTGCA CACAGTAcatc | | TCTCGTCAACTTGTTGGCGAGA | |
| 164 | SauriCas9-KKH | + | ATGTCTGATGTACTGTGTGCAGTTTTAGTAC TCTGGAAACAGAATCTACTAAAACAAGGCA AAATGCCGTGTTTATCTCGTCAACTTGTTGG CGAGAggtggcctggccttcCGAGTCTTCCACTGCA CACAGTAcatc | 29476 | GTTTTCTTTCTTCTTTTCATCGTTTTAGTACTCTGGAAA CAGAATCTACTAAAACAAGGCAAAATGCCGTGTTTAT CTCGTCAACTTGTTGGCGAGA | 29653 |
| 165 | SauriCas9 | - | TCTCGGGATTTCTTGGGTGGCGTTTTAGTAC TCTGGAAACAGAATCTACTAAAACAAGGCA AAATGCCGTGTTTATCTCGTCAACTTGTTGG CGAGAtgtgcagtggaagacTCGGAAGGCCAGGCC ACCCAAGAaatc | 29477 | GGCGCTCATTGTGCCTGGCAAGTTTTAGTACTCTGGA AACAGAATCTACTAAAACAAGGCAAAATGCCGTGTTT ATCTCGTCAACTTGTTGGCGAGA | 29654 |
| 166 | SauriCas9-KKH | - | TCTCGGGATTTCTTGGGTGGCGTTTTAGTAC TCTGGAAACAGAATCTACTAAAACAAGGCA AAATGCCGTGTTTATCTCGTCAACTTGTTGG CGAGAtgtgcagtggaagacTCGGAAGGCCAGGCC ACCCAAGAaatc | 29478 | GCTCATTGTGCCTGGCAACTGGTTTTAGTACTCTGGA AACAGAATCTACTAAAACAAGGCAAAATGCCGTGTTT ATCTCGTCAACTTGTTGGCGAGA | 29655 |
| 169 | ScaCas9-Sc++ | + | TGTCTGATGTACTGTGTGCAGTTTTAGAGCT AGAAATAGCAAGTTAAAATAAGGCTAGTCC GTTATCAACTTGAAAAAGTGGCACCGAGTC GGTGCggtggcctggccttcCGAGTCTTCCACTGCA CACAGTAcatc | 29479 | TTTCTTTCTTCTTTTCATCCGTTTTAGAGCTAGAAATA GCAAGTTAAAATAAGGCTAGTCCGTTATCAACTTGAA AAAGTGGCACCGAGTCGGTGC | 29656 |
| 170 | SpyCas9-SpRY | + | TGTCTGATGTACTGTGTGCAGTTTTAGAGCT AGAAATAGCAAGTTAAAATAAGGCTAGTCC GTTATCAACTTGAAAAAGTGGCACCGAGTC GGTGCggtggcctggccttcCGAGTCTTCCACTGCA CACAGTAcatc | 29480 | TGAGTTTTCTTTCTTCTTTTGTTTTAGAGCTAGAAATA GCAAGTTAAAATAAGGCTAGTCCGTTATCAACTTGAA AAAGTGGCACCGAGTCGGTGC | 29657 |
| 173 | ScaCas9-Sc++ | - | CTCGGGATTTCTTGGGTGGCGTTTTAGAGCT AGAAATAGCAAGTTAAAATAAGGCTAGTCC GTTATCAACTTGAAAAAGTGGCACCGAGTC GGTGCtgtgcagtggaagacTCGGAAGGCCAGGCC ACCCAAGAaatc | 29481 | CGCTCATTGTGCCTGGCAACGTTTTAGAGCTAGAAAT AGCAAGTTAAAATAAGGCTAGTCCGTTATCAACTTGA AAAAGTGGCACCGAGTCGGTGC | 29658 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 174 | SpyCas9-SpRY | - | CTCGGGATTTCTTGGGTGGCGTTTTAGAGCTAGAAATAGCAAGTTAAAATAAGGCTAGTCCGTTATCAACTTGAAAAAGTGGCACCGAGTCGGTGCtgtgcagtggaagacTCGGAAGGCCAGGCCACCCAAGAaatc | 29482 | GCTCATTGTGCCTGGCAACTGTTTTAGAGCTAGAAATAGCAAGTTAAAATAAGGCTAGTCCGTTATCAACTTGAAAAAGTGGCACCGAGTCGGTGC | 29659 |
| 175 | BlatCas9 | - | cctcTCGGGATTTCTTGGGTGGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTtgtgcagtggaagacTCGGAAGGCCAGGCCACCCAAGAaatc | 29483 | gcgcTCATTGTGCCTGGCAACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29660 |
| 176 | BlatCas9 | - | cctcTCGGGATTTCTTGGGTGGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTtgtgcagtggaagacTCGGAAGGCCAGGCCACCCAAGAaatc | 29484 | gcgcTCATTGTGCCTGGCAACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29661 |
| 179 | SauCas9KKH | + | CATGTCTGATGTACTGTGTGCGTTTTAGTACTCTGGAAACAGAATCTACTAAAACAAGGCAAAATGCCGTGTTTATCTCGTCAACTTGTTGGCGAGAgtggcctggccttcCGAGTCTTCCACTGCACACAGTACatca | 29485 | AGTTTTCTTTCTTCTTTTCATGTTTTAGTACTCTGGAAACAGAATCTACTAAAACAAGGCAAAATGCCGTGTTTATCTCGTCAACTTGTTGGCGAGA | 29662 |
| 180 | SauCas9KKH | - | CTCTCGGGATTTCTTGGGTGGGTTTTAGTACTCTGGAAACAGAATCTACTAAAACAAGGCAAAATGCCGTGTTTATCTCGTCAACTTGTTGGCGAGAgtgcagtggaagacTCGGAAGGCCAGGCCACCCAAGAAatcc | 29486 | CGCTCATTGTGCCTGGCAACTGTTTTAGTACTCTGGAAACAGAATCTACTAAAACAAGGCAAAATGCCGTGTTTATCTCGTCAACTTGTTGGCGAGA | 29663 |
| 181 | SpyCas9-NG | + | ATGTCTGATGTACTGTGTGCGTTTTAGAGCTAGAAATAGCAAGTTAAAATAAGGCTAGTCCGTTATCAACTTGAAAAAGTGGCACCGAGTCGGTGCgtggcctggccttcCGAGTCTTCCACTGCACACAGTACatca | 29487 | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGC | 29664 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 185 | SpyCas9-SpRY | + | ATGTCTGATGTACTGTGTGCGTTTTAGAGCTAGAAATAGCAAGTTAAAATAAGGCTAGTCCGTTATCAACTTGAAAAAGTGGCACCGAGTCGGTGCgtggcctggccttcCGAGTCTTCCACTGCACACAGTACatca | 29488 | GAGTTTTCTTTCTTCTTTTCGTTTTAGAGCTAGAAATAGCAAGTTAAAATAAGGCTAGTCCGTTATCAACTTGAAAAAGTGGCACCGAGTCGGTGC | 29665 |
| 186 | SpyCas9-SpRY | - | TCTCGGGATTTCTTGGGTGGGTTTTAGAGCTAGAAATAGCAAGTTAAAATAAGGCTAGTCCGTTATCAACTTGAAAAAGTGGCACCGAGTCGGTGCgtgcagtggaagacTCGGAAGGCCAGGCCACCCAAGAAatcc | 29489 | CTCATTGTGCCTGGCAACTGGTTTTAGAGCTAGAAATAGCAAGTTAAAATAAGGCTAGTCCGTTATCAACTTGAAAAAGTGGCACCGAGTCGGTGC | 29666 |
| 189 | ScaCas9-Sc++ | + | CATGTCTGATGTACTGTGTGGTTTTAGAGCTAGAAATAGCAAGTTAAAATAAGGCTAGTCCGTTATCAACTTGAAAAAGTGGCACCGAGTCGGTGCtggcctggccttcCGAGTCTTCCACTGCACACAGTACAtcag | 29490 | TTTCTTTCTTCTTTTCATCCGTTTTAGAGCTAGAAATAGCAAGTTAAAATAAGGCTAGTCCGTTATCAACTTGAAAAAGTGGCACCGAGTCGGTGC | 29667 |
| 190 | SpyCas9-SpRY | + | CATGTCTGATGTACTGTGTGGTTTTAGAGCTAGAAATAGCAAGTTAAAATAAGGCTAGTCCGTTATCAACTTGAAAAAGTGGCACCGAGTCGGTGCtggcctggccttcCGAGTCTTCCACTGCACACAGTACAtcag | 29491 | AGTTTTCTTTCTTCTTTTCAGTTTTAGAGCTAGAAATAGCAAGTTAAAATAAGGCTAGTCCGTTATCAACTTGAAAAAGTGGCACCGAGTCGGTGC | 29668 |
| 191 | SpyCas9-SpRY | - | CTCTCGGGATTTCTTGGGTGGTTTTAGAGCTAGAAATAGCAAGTTAAAATAAGGCTAGTCCGTTATCAACTTGAAAAAGTGGCACCGAGTCGGTGCtgcagtggaagacTCGGAAGGCCAGGCCACCCAAGAAAtccc | 29492 | TCATTGTGCCTGGCAACTGGGTTTTAGAGCTAGAAATAGCAAGTTAAAATAAGGCTAGTCCGTTATCAACTTGAAAAAGTGGCACCGAGTCGGTGC | 29669 |
| 193 | SauriCas9-KKH | + | TCCATGTCTGATGTACTGTGTGTTTTAGTACTCTGGAAACAGAATCTACTAAAACAAGGCAAAATGCCGTGTTTATCTCGTCAACTTGTTGGCGAGAggcctggccttcCGAGTCTTCCACTGCACACAGTACATcaga | 29493 | GTTTTCTTTCTTCTTTTCATCGTTTTAGTACTCTGGAAACAGAATCTACTAAAACAAGGCAAAATGCCGTGTTTATCTCGTCAACTTGTTGGCGAGA | 29670 |
| 194 | SpyCas9-NG | - | CCTCTCGGGATTTCTTGGGTGTTTTAGAGCTAGAAATAGCAAGTTAAAATAAGGCTAGTCCGTTATCAACTTGAAAAAGTGGCACCGAGTCGGTGCgcagtggaagacTCGGAAGGCCAGGCCACCCAAGAAATcccg | 29494 | CATTGTGCCTGGCAACTGGTGTTTTAGAGCTAGAAATAGCAAGTTAAAATAAGGCTAGTCCGTTATCAACTTGAAAAAGTGGCACCGAGTCGGTGC | 29671 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 198 | SpyCas9-SpRY | - | CCTCTCGGGATTTCTTGGGTGTTTTAGAGCTAGAAATAGCAAGTTAAAATAAGGCTAGTCCGTTATCAACTTGAAAAAGTGGCACCGAGTCGGTGCgcagtggaagacTCGGAAGGCCAGGCCACCCAAGAAATcccg | 29495 | CATTGTGCCTGGCAACTGGTGTTTTAGAGCTAGAAATAGCAAGTTAAAATAAGGCTAGTCCGTTATCAACTTGAAAAAGTGGCACCGAGTCGGTGC | 29672 |
| 199 | SpyCas9-SpRY | + | CCATGTCTGATGTACTGTGTGTTTTAGAGCTAGAAATAGCAAGTTAAAATAAGGCTAGTCCGTTATCAACTTGAAAAAGTGGCACCGAGTCGGTGCggcctggccttcCGAGTCTTCCACTGCACACAGTACATcaga | 29496 | GTTTTCTTTCTTCTTTTCATGTTTTAGAGCTAGAAATAGCAAGTTAAAATAAGGCTAGTCCGTTATCAACTTGAAAAAGTGGCACCGAGTCGGTGC | 29673 |
| 203 | SauCas9KKH | + | ATCCATGTCTGATGTACTGTGGTTTTAGTACTCTGGAAACAGAATCTACTAAAACAAGGCAAAATGCCGTGTTTATCTCGTCAACTTGTTGGCGAGAgcctggccttcCGAGTCTTCCACTGCACACAGTACATCagac | 29497 | AGTTTTCTTTCTTCTTTTCATGTTTTAGTACTCTGGAAACAGAATCTACTAAAACAAGGCAAAATGCCGTGTTTATCTCGTCAACTTGTTGGCGAGA | 29674 |
| 204 | SauCas9KKH | + | ATCCATGTCTGATGTACTGTGGTTTTAGTACTCTGGAAACAGAATCTACTAAAACAAGGCAAAATGCCGTGTTTATCTCGTCAACTTGTTGGCGAGAgcctggccttcCGAGTCTTCCACTGCACACAGTACATCagac | 29498 | AGTTTTCTTTCTTCTTTTCATGTTTTAGTACTCTGGAAACAGAATCTACTAAAACAAGGCAAAATGCCGTGTTTATCTCGTCAACTTGTTGGCGAGA | 29675 |
| 209 | ScaCas9-Sc++ | - | TCCTCTCGGGATTTCTTGGGGTTTTAGAGCTAGAAATAGCAAGTTAAAATAAGGCTAGTCCGTTATCAACTTGAAAAAGTGGCACCGAGTCGGTGCcagtggaagacTCGGAAGGCCAGGCCACCCAAGAAATCccga | 29499 | TTGTGCCTGGCAACTGGTAGGTTTTAGAGCTAGAAATAGCAAGTTAAAATAAGGCTAGTCCGTTATCAACTTGAAAAAGTGGCACCGAGTCGGTGC | 29676 |
| 210 | SpyCas9 | - | TCCTCTCGGGATTTCTTGGGGTTTTAGAGCTAGAAATAGCAAGTTAAAATAAGGCTAGTCCGTTATCAACTTGAAAAAGTGGCACCGAGTCGGTGCcagtggaagacTCGGAAGGCCAGGCCACCCAAGAAATCccga | 29500 | TGTGCCTGGCAACTGGTAGCGTTTTAGAGCTAGAAATAGCAAGTTAAAATAAGGCTAGTCCGTTATCAACTTGAAAAAGTGGCACCGAGTCGGTGC | 29677 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 213 | SpyCas9-SpRY | - | TCCTCTCGGGATTTCTTGGGGTTTTAGAGCTAGAAATAGCAAGTTAAAATAAGGCTAGTCCGTTATCAACTTGAAAAAGTGGCACCGAGTCGGTGCcagtggaagacTCGGAAGGCCAGGCCACCCAAGAAATCccga | 29501 | ATTGTGCCTGGCAACTGGTAGTTTTAGAGCTAGAAATAGCAAGTTAAAATAAGGCTAGTCCGTTATCAACTTGAAAAAGTGGCACCGAGTCGGTGC | 29678 |
| 214 | SpyCas9-NG | + | TCCATGTCTGATGTACTGTGGTTTTAGAGCTAGAAATAGCAAGTTAAAATAAGGCTAGTCCGTTATCAACTTGAAAAAGTGGCACCGAGTCGGTGCgcctggccttcCGAGTCTTCCACTGCACACAGTACATCagac | 29502 | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGC | 29679 |
| 217 | SpyCas9-NG | - | TCCTCTCGGGATTTCTTGGGGTTTTAGAGCTAGAAATAGCAAGTTAAAATAAGGCTAGTCCGTTATCAACTTGAAAAAGTGGCACCGAGTCGGTGCcagtggaagacTCGGAAGGCCAGGCCACCCAAGAAATCccga | 29503 | CATTGTGCCTGGCAACTGGTGTTTTAGAGCTAGAAATAGCAAGTTAAAATAAGGCTAGTCCGTTATCAACTTGAAAAAGTGGCACCGAGTCGGTGC | 29680 |
| 221 | SpyCas9-SpRY | + | TCCATGTCTGATGTACTGTGGTTTTAGAGCTAGAAATAGCAAGTTAAAATAAGGCTAGTCCGTTATCAACTTGAAAAAGTGGCACCGAGTCGGTGCgcctggccttcCGAGTCTTCCACTGCACACAGTACATCagac | 29504 | TTTTCTTTCTTCTTTTCATCGTTTTAGAGCTAGAAATAGCAAGTTAAAATAAGGCTAGTCCGTTATCAACTTGAAAAAGTGGCACCGAGTCGGTGC | 29681 |
| 222 | BlatCas9 | - | ctttCCTCTCGGGATTTCTTGGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcagtggaagacTCGGAAGGCCAGGCCACCCAAGAAATCccga | 29505 | gcgcTCATTGTGCCTGGCAACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29682 |
| 223 | BlatCas9 | - | ctttCCTCTCGGGATTTCTTGGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcagtggaagacTCGGAAGGCCAGGCCACCCAAGAAATCccga | 29506 | gcgcTCATTGTGCCTGGCAACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29683 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 226 | Nme2Cas9 | - | tgCTTTCCTCTCGGGATTTCTTGGGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAagtggaagacTCGGAAGGCCAGGCCACCCAAGAAATCCcgag | 29507 | gcAGCAGGAAAAGATGGCGCTCATGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29684 |
| 227 | SauriCas9 | - | TTTCCTCTCGGGATTTCTTGGGTTTTAGTACTCTGGAAACAGAATCTACTAAAACAAGGCAAAATGCCGTGTTTATCTCGTCAACTTGTTGGCGAGAagtggaagacTCGGAAGGCCAGGCCACCCAAGAAATCCcgag | 29508 | ATTGTGCCTGGCAACTGGTAGGTTTTAGTACTCTGGAAACAGAATCTACTAAAACAAGGCAAAATGCCGTGTTTATCTCGTCAACTTGTTGGCGAGA | 29685 |
| 228 | SauriCas9-KKH | - | TTTCCTCTCGGGATTTCTTGGGTTTTAGTACTCTGGAAACAGAATCTACTAAAACAAGGCAAAATGCCGTGTTTATCTCGTCAACTTGTTGGCGAGAagtggaagacTCGGAAGGCCAGGCCACCCAAGAAATCCcgag | 29509 | ATTGTGCCTGGCAACTGGTAGGTTTTAGTACTCTGGAAACAGAATCTACTAAAACAAGGCAAAATGCCGTGTTTATCTCGTCAACTTGTTGGCGAGA | 29686 |
| 231 | ScaCas9-Sc++ | + | ATCCATGTCTGATGTACTGTGTTTTAGAGCTAGAAATAGCAAGTTAAAATAAGGCTAGTCCGTTATCAACTTGAAAAAGTGGCACCGAGTCGGTGCcctggccttcCGAGTCTTCCACTGCACACAGTACATCAgaca | 29510 | TTTCTTTCTTCTTTTCATCCGTTTTAGAGCTAGAAATAGCAAGTTAAAATAAGGCTAGTCCGTTATCAACTTGAAAAAGTGGCACCGAGTCGGTGC | 29687 |
| 232 | SpyCas9-SpRY | + | ATCCATGTCTGATGTACTGTGTTTTAGAGCTAGAAATAGCAAGTTAAAATAAGGCTAGTCCGTTATCAACTTGAAAAAGTGGCACCGAGTCGGTGCcctggccttcCGAGTCTTCCACTGCACACAGTACATCAgaca | 29511 | TTTCTTTCTTCTTTTCATCCGTTTTAGAGCTAGAAATAGCAAGTTAAAATAAGGCTAGTCCGTTATCAACTTGAAAAAGTGGCACCGAGTCGGTGC | 29688 |
| 235 | ScaCas9-Sc++ | - | TTCCTCTCGGGATTTCTTGGGTTTTAGAGCTAGAAATAGCAAGTTAAAATAAGGCTAGTCCGTTATCAACTTGAAAAAGTGGCACCGAGTCGGTGCagtggaagacTCGGAAGGCCAGGCCACCCAAGAAATCCcgag | 29512 | TTGTGCCTGGCAACTGGTAGGTTTTAGAGCTAGAAATAGCAAGTTAAAATAAGGCTAGTCCGTTATCAACTTGAAAAAGTGGCACCGAGTCGGTGC | 29689 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 236 | SpyCas9-SpRY | - | TTCCTCTCGGGATTTCTTGGGTTTTAGAGCTAGAAATAGCAAGTTAAAATAAGGCTAGTCCGTTATCAACTTGAAAAAGTGGCACCGAGTCGGTGCagtggaagacTCGGAAGGCCAGGCCACCCAAGAAATCCcgag | 29513 | TTGTGCCTGGCAACTGGTAGGTTTTAGAGCTAGAAATAGCAAGTTAAAATAAGGCTAGTCCGTTATCAACTTGAAAAAGTGGCACCGAGTCGGTGC | 29690 |
| 237 | BlatCas9 | - | gcttTCCTCTCGGGATTTCTTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTagtggaagacTCGGAAGGCCAGGCCACCCAAGAAATCCcgag | 29514 | gcgcTCATTGTGCCTGGCAACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29691 |
| 238 | BlatCas9 | - | gcttTCCTCTCGGGATTTCTTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTagtggaagacTCGGAAGGCCAGGCCACCCAAGAAATCCcgag | 29515 | gcgcTCATTGTGCCTGGCAACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29692 |
| 239 | SauCas9KKH | - | CTTTCCTCTCGGGATTTCTTGGTTTTAGTACTCTGGAAACAGAATCTACTAAAACAAGGCAAAATGCCGTGTTTATCTCGTCAACTTGTTGGCGAGAgtggaagacTCGGAAGGCCAGGCCACCCAAGAAATCCCgaga | 29516 | TTGTGCCTGGCAACTGGTAGCGTTTTAGTACTCTGGAAACAGAATCTACTAAAACAAGGCAAAATGCCGTGTTTATCTCGTCAACTTGTTGGCGAGA | 29693 |
| 240 | SpyCas9-NG | + | GATCCATGTCTGATGTACTGGTTTTAGAGCTAGAAATAGCAAGTTAAAATAAGGCTAGTCCGTTATCAACTTGAAAAAGTGGCACCGAGTCGGTGCctggccttcCGAGTCTTCCACTGCACACAGTACATCAGacat | 29517 | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGC | 29694 |
| 243 | SpyCas9-NG | - | TTTCCTCTCGGGATTTCTTGGTTTTAGAGCTAGAAATAGCAAGTTAAAATAAGGCTAGTCCGTTATCAACTTGAAAAAGTGGCACCGAGTCGGTGCgtggaagacTCGGAAGGCCAGGCCACCCAAGAAATCCCgaga | 29518 | TGTGCCTGGCAACTGGTAGCGTTTTAGAGCTAGAAATAGCAAGTTAAAATAAGGCTAGTCCGTTATCAACTTGAAAAAGTGGCACCGAGTCGGTGC | 29695 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 247 | SpyCas9-SpRY | + | GATCCATGTCTGATGTACTGGTTTTAGAGCTAGAAATAGCAAGTTAAAATAAGGCTAGTCCGTTATCAACTTGAAAAAGTGGCACCGAGTCGGTGCctggccttcCGAGTCTTCCACTGCACACAGTACATCAGacat | 29519 | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGC | 29696 |
| 249 | SpyCas9-SpRY | - | TTTCCTCTCGGGATTTCTTGGTTTTAGAGCTAGAAATAGCAAGTTAAAATAAGGCTAGTCCGTTATCAACTTGAAAAAGTGGCACCGAGTCGGTGCgtggaagacTCGGAAGGCCAGGCCACCCAAGAAATCCCgaga | 29520 | TGTGCCTGGCAACTGGTAGCGTTTTAGAGCTAGAAATAGCAAGTTAAAATAAGGCTAGTCCGTTATCAACTTGAAAAAGTGGCACCGAGTCGGTGC | 29697 |
| 250 | BlatCas9 | + | ttggATCCATGTCTGATGTACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTctggccttcCGAGTCTTCCACTGCACACAGTACATCAGacat | 29521 | gagtTTTCTTTCTTCTTTTCATCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29698 |
| 251 | BlatCas9 | + | ttggATCCATGTCTGATGTACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTctggccttcCGAGTCTTCCACTGCACACAGTACATCAGacat | 29522 | gagtTTTCTTTCTTCTTTTCATCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29699 |
| 254 | ScaCas9-Sc++ | + | GGATCCATGTCTGATGTACTGTTTTAGAGCTAGAAATAGCAAGTTAAAATAAGGCTAGTCCGTTATCAACTTGAAAAAGTGGCACCGAGTCGGTGCtggccttcCGAGTCTTCCACTGCACACAGTACATCAGAcatg | 29523 | TTTCTTTCTTCTTTTCATCCGTTTTAGAGCTAGAAATAGCAAGTTAAAATAAGGCTAGTCCGTTATCAACTTGAAAAAGTGGCACCGAGTCGGTGC | 29700 |
| 255 | SpyCas9-SpRY | + | GGATCCATGTCTGATGTACTGTTTTAGAGCTAGAAATAGCAAGTTAAAATAAGGCTAGTCCGTTATCAACTTGAAAAAGTGGCACCGAGTCGGTGCtggccttcCGAGTCTTCCACTGCACACAGTACATCAGAcatg | 29524 | TCTTTCTTCTTTTCATCCCAGTTTTAGAGCTAGAAATAGCAAGTTAAAATAAGGCTAGTCCGTTATCAACTTGAAAAAGTGGCACCGAGTCGGTGC | 29701 |

TABLE 4B-continued

Exemplary template RNA sequences and second nick gRNA spacer sequences

Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 258 | ScaCas9-Sc++ | - | CTTTCCTCTCGGGATTTCTTGTTTTAGAGCTAGAAATAGCAAGTTAAAATAAGGCTAGTCCGTTATCAACTTGAAAAAGTGGCACCGAGTCGGTGCtggaagacTCGGAAGGCCAGGCCACCCAAGAAATCCCGagag | 29525 | TGTGCCTGGCAACTGGTAGCGTTTTAGAGCTAGAAATAGCAAGTTAAAATAAGGCTAGTCCGTTATCAACTTGAAAAAGTGGCACCGAGTCGGTGC | 29702 |
| 259 | SpyCas9 | - | CTTTCCTCTCGGGATTTCTTGTTTTAGAGCTAGAAATAGCAAGTTAAAATAAGGCTAGTCCGTTATCAACTTGAAAAAGTGGCACCGAGTCGGTGCtggaagacTCGGAAGGCCAGGCCACCCAAGAAATCCCGagag | 29526 | TGTGCCTGGCAACTGGTAGCGTTTTAGAGCTAGAAATAGCAAGTTAAAATAAGGCTAGTCCGTTATCAACTTGAAAAAGTGGCACCGAGTCGGTGC | 29703 |
| 262 | SpyCas9-SpRY | - | CTTTCCTCTCGGGATTTCTTGTTTTAGAGCTAGAAATAGCAAGTTAAAATAAGGCTAGTCCGTTATCAACTTGAAAAAGTGGCACCGAGTCGGTGCtggaagacTCGGAAGGCCAGGCCACCCAAGAAATCCCGagag | 29527 | GTGCCTGGCAACTGGTAGCTGTTTTAGAGCTAGAAATAGCAAGTTAAAATAAGGCTAGTCCGTTATCAACTTGAAAAAGTGGCACCGAGTCGGTGC | 29704 |
| 263 | SpyCas9-NG | - | CTTTCCTCTCGGGATTTCTTGTTTTAGAGCTAGAAATAGCAAGTTAAAATAAGGCTAGTCCGTTATCAACTTGAAAAAGTGGCACCGAGTCGGTGCtggaagacTCGGAAGGCCAGGCCACCCAAGAAATCCCGagag | 29528 | GTGCCTGGCAACTGGTAGCTGTTTTAGAGCTAGAAATAGCAAGTTAAAATAAGGCTAGTCCGTTATCAACTTGAAAAAGTGGCACCGAGTCGGTGC | 29705 |
| 267 | SauriCas9 | - | TGCTTTCCTCTCGGGATTTCTGTTTTAGTACTCTGGAAACAGAATCTACTAAAACAAGGCAAAATGCCGTGTTTATCTCGTCAACTTGTTGGCGAGAggaagacTCGGAAGGCCAGGCCACCCAAGAAATCCCGAgagg | 29529 | GTGCCTGGCAACTGGTAGCTGGTTTTAGTACTCTGGAAACAGAATCTACTAAAACAAGGCAAAATGCCGTGTTTATCTCGTCAACTTGTTGGCGAGA | 29706 |
| 268 | SauriCas9-KKH | - | TGCTTTCCTCTCGGGATTTCTGTTTTAGTACTCTGGAAACAGAATCTACTAAAACAAGGCAAAATGCCGTGTTTATCTCGTCAACTTGTTGGCGAGAggaagacTCGGAAGGCCAGGCCACCCAAGAAATCCCGAgagg | 29530 | GTGCCTGGCAACTGGTAGCTGGTTTTAGTACTCTGGAAACAGAATCTACTAAAACAAGGCAAAATGCCGTGTTTATCTCGTCAACTTGTTGGCGAGA | 29707 |
| 271 | ScaCas9-Sc++ | - | GCTTTCCTCTCGGGATTTCTGTTTTAGAGCTAGAAATAGCAAGTTAAAATAAGGCTAGTCCGTTATCAACTTGAAAAAGTGGCACCGAGTCGGTGCggaagacTCGGAAGGCCAGGCCACCCAAGAAATCCCGAgagg | 29531 | TGCCTGGCAACTGGTAGCTGGTTTTAGAGCTAGAAATAGCAAGTTAAAATAAGGCTAGTCCGTTATCAACTTGAAAAAGTGGCACCGAGTCGGTGC | 29708 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 272 | SpyCas9 | - | GCTTTCCTCTCGGGATTTCTGTTTTAGAGCTAGAAATAGCAAGTTAAAATAAGGCTAGTCCGTTATCAACTTGAAAAAGTGGCACCGAGTCGGTGCggaagacTCGGAAGGCCAGGCCACCCAAGAAATCCCGAgagg | 29532 | GCCTGGCAACTGGTAGCTGGGTTTTAGAGCTAGAAATAGCAAGTTAAAATAAGGCTAGTCCGTTATCAACTTGAAAAAGTGGCACCGAGTCGGTGC | 29709 |
| 275 | SpyCas9-SpRY | - | GCTTTCCTCTCGGGATTTCTGTTTTAGAGCTAGAAATAGCAAGTTAAAATAAGGCTAGTCCGTTATCAACTTGAAAAAGTGGCACCGAGTCGGTGCggaagacTCGGAAGGCCAGGCCACCCAAGAAATCCCGAgagg | 29533 | TGCCTGGCAACTGGTAGCTGGTTTTAGAGCTAGAAATAGCAAGTTAAAATAAGGCTAGTCCGTTATCAACTTGAAAAAGTGGCACCGAGTCGGTGC | 29710 |
| 276 | SpyCas9-NG | + | TGGATCCATGTCTGATGTACGTTTTAGAGCTAGAAATAGCAAGTTAAAATAAGGCTAGTCCGTTATCAACTTGAAAAAGTGGCACCGAGTCGGTGCggccttcCGAGTCTTCCACTGCACACAGTACATCAGACatgg | 29534 | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGC | 29711 |
| 279 | SpyCas9-NG | - | GCTTTCCTCTCGGGATTTCTGTTTTAGAGCTAGAAATAGCAAGTTAAAATAAGGCTAGTCCGTTATCAACTTGAAAAAGTGGCACCGAGTCGGTGCggaagacTCGGAAGGCCAGGCCACCCAAGAAATCCCGAgagg | 29535 | GTGCCTGGCAACTGGTAGCTGTTTTAGAGCTAGAAATAGCAAGTTAAAATAAGGCTAGTCCGTTATCAACTTGAAAAAGTGGCACCGAGTCGGTGC | 29712 |
| 283 | SpyCas9-SpRY | + | TGGATCCATGTCTGATGTACGTTTTAGAGCTAGAAATAGCAAGTTAAAATAAGGCTAGTCCGTTATCAACTTGAAAAAGTGGCACCGAGTCGGTGCggccttcCGAGTCTTCCACTGCACACAGTACATCAGACatgg | 29536 | CTTTCTTCTTTTCATCCCAGGTTTTAGAGCTAGAAATAGCAAGTTAAAATAAGGCTAGTCCGTTATCAACTTGAAAAAGTGGCACCGAGTCGGTGC | 29713 |
| 286 | SauCas9 | - | gcCTGCTTTCCTCTCGGGATTTCGTTTTAGTACTCTGGAAACAGAATCTACTAAAACAAGGCAAAATGCCGTGTTTATCTCGTCAACTTGTTGGCGAGAgaagacTCGGAAGGCCAGGCCACCCAAGAAATCCCGAGagga | 29537 | ttGTGCCTGGCAACTGGTAGCTGGTTTTAGTACTCTGGAAACAGAATCTACTAAAACAAGGCAAAATGCCGTGTTTATCTCGTCAACTTGTTGGCGAGA | 29714 |
| 287 | SauCas9KKH | - | CTGCTTTCCTCTCGGGATTTCGTTTTAGTACTCTGGAAACAGAATCTACTAAAACAAGGCAAAATGCCGTGTTTATCTCGTCAACTTGTTGGCGAGAgaagacTCGGAAGGCCAGGCCACCCAAGAAATCCCGAGagga | 29538 | GTGCCTGGCAACTGGTAGCTGGTTTTAGTACTCTGGAAACAGAATCTACTAAAACAAGGCAAAATGCCGTGTTTATCTCGTCAACTTGTTGGCGAGA | 29715 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 288 | SauCas9 | - | gcCTGCTTTCCTCTCGGGATTTCGTTTTAGTACTCTGGAAACAGAATCTACTAAAACAAGGCAAAATGCCGTGTTTATCTCGTCAACTTGTTGGCGAGAgaagacTCGGAAGGCCAGGCCACCCAAGAAATCCCGAGagga | 29539 | ttGTGCCTGGCAACTGGTAGCTGGTTTTAGTACTCTGGAAACAGAATCTACTAAAACAAGGCAAAATGCCGTGTTTATCTCGTCAACTTGTTGGCGAGA | 29716 |
| 289 | SauCas9KKH | - | CTGCTTTCCTCTCGGGATTTCGTTTTAGTACTCTGGAAACAGAATCTACTAAAACAAGGCAAAATGCCGTGTTTATCTCGTCAACTTGTTGGCGAGAgaagacTCGGAAGGCCAGGCCACCCAAGAAATCCCGAGagga | 29540 | GTGCCTGGCAACTGGTAGCTGGTTTTAGTACTCTGGAAACAGAATCTACTAAAACAAGGCAAAATGCCGTGTTTATCTCGTCAACTTGTTGGCGAGA | 29717 |
| 292 | SauriCas9 | - | CTGCTTTCCTCTCGGGATTTCGTTTTAGTACTCTGGAAACAGAATCTACTAAAACAAGGCAAAATGCCGTGTTTATCTCGTCAACTTGTTGGCGAGAgaagacTCGGAAGGCCAGGCCACCCAAGAAATCCCGAGagga | 29541 | GTGCCTGGCAACTGGTAGCTGGTTTTAGTACTCTGGAAACAGAATCTACTAAAACAAGGCAAAATGCCGTGTTTATCTCGTCAACTTGTTGGCGAGA | 29718 |
| 293 | SauriCas9-KKH | - | CTGCTTTCCTCTCGGGATTTCGTTTTAGTACTCTGGAAACAGAATCTACTAAAACAAGGCAAAATGCCGTGTTTATCTCGTCAACTTGTTGGCGAGAgaagacTCGGAAGGCCAGGCCACCCAAGAAATCCCGAGagga | 29542 | GTGCCTGGCAACTGGTAGCTGGTTTTAGTACTCTGGAAACAGAATCTACTAAAACAAGGCAAAATGCCGTGTTTATCTCGTCAACTTGTTGGCGAGA | 29719 |
| 296 | ScaCas9-Sc++ | + | TTGGATCCATGTCTGATGTAGTTTTAGAGCTAGAAATAGCAAGTTAAAATAAGGCTAGTCCGTTATCAACTTGAAAAAGTGGCACCGAGTCGGTGCgccttcCGAGTCTTCCACTGCACACAGTACATCAGACAtgga | 29543 | TTTCTTCTTTTCATCCCAGCGTTTTAGAGCTAGAAATAGCAAGTTAAAATAAGGCTAGTCCGTTATCAACTTGAAAAAGTGGCACCGAGTCGGTGC | 29720 |
| 297 | SpyCas9-SpRY | + | TTGGATCCATGTCTGATGTAGTTTTAGAGCTAGAAATAGCAAGTTAAAATAAGGCTAGTCCGTTATCAACTTGAAAAAGTGGCACCGAGTCGGTGCgccttcCGAGTCTTCCACTGCACACAGTACATCAGACAtgga | 29544 | TTTCTTCTTTTCATCCCAGCGTTTTAGAGCTAGAAATAGCAAGTTAAAATAAGGCTAGTCCGTTATCAACTTGAAAAAGTGGCACCGAGTCGGTGC | 29721 |

TABLE 4B-continued

Exemplary template RNA sequences and second nick gRNA spacer sequences

Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 300 | ScaCas9-Sc++ | - | TGCTTTCCTCTCGGGATTTCGTTTTAGAGCTAGAAATAGCAAGTTAAAATAAGGCTAGTCCGTTATCAACTTGAAAAAGTGGCACCGAGTCGGTGCgaagacTCGGAAGGCCAGGCCACCCAAGAAATCCCGAGagga | 29545 | GCCTGGCAACTGGTAGCTGGGTTTTAGAGCTAGAAATAGCAAGTTAAAATAAGGCTAGTCCGTTATCAACTTGAAAAAGTGGCACCGAGTCGGTGC | 29722 |
| 301 | SpyCas9-SpRY | - | TGCTTTCCTCTCGGGATTTCGTTTTAGAGCTAGAAATAGCAAGTTAAAATAAGGCTAGTCCGTTATCAACTTGAAAAAGTGGCACCGAGTCGGTGCgaagacTCGGAAGGCCAGGCCACCCAAGAAATCCCGAGagga | 29546 | GCCTGGCAACTGGTAGCTGGGTTTTAGAGCTAGAAATAGCAAGTTAAAATAAGGCTAGTCCGTTATCAACTTGAAAAAGTGGCACCGAGTCGGTGC | 29723 |
| 302 | SauCas9KKH | - | CCTGCTTTCCTCTCGGGATTTGTTTTAGTACTCTGGAAACAGAATCTACTAAAACAAGGCAAAATGCCGTGTTTATCTCGTCAACTTGTTGGCGAGAaagacTCGGAAGGCCAGGCCACCCAAGAAATCCCGAGAggaa | 29547 | CCTGGCAACTGGTAGCTGGAGGTTTTAGTACTCTGGAAACAGAATCTACTAAAACAAGGCAAAATGCCGTGTTTATCTCGTCAACTTGTTGGCGAGA | 29724 |
| 303 | SpyCas9-SpRY | + | CTTGGATCCATGTCTGATGTGTTTTAGAGCTAGAAATAGCAAGTTAAAATAAGGCTAGTCCGTTATCAACTTGAAAAAGTGGCACCGAGTCGGTGCccttcCGAGTCTTCCACTGCACACAGTACATCAGACATggat | 29548 | TTCTTCTTTTCATCCCAGCTGTTTTAGAGCTAGAAATAGCAAGTTAAAATAAGGCTAGTCCGTTATCAACTTGAAAAAGTGGCACCGAGTCGGTGC | 29725 |
| 304 | SpyCas9-SpRY | - | CTGCTTTCCTCTCGGGATTTGTTTTAGAGCTAGAAATAGCAAGTTAAAATAAGGCTAGTCCGTTATCAACTTGAAAAAGTGGCACCGAGTCGGTGCaagacTCGGAAGGCCAGGCCACCCAAGAAATCCCGAGAggaa | 29549 | CCTGGCAACTGGTAGCTGGAGTTTTAGAGCTAGAAATAGCAAGTTAAAATAAGGCTAGTCCGTTATCAACTTGAAAAAGTGGCACCGAGTCGGTGC | 29726 |
| 305 | SpyCas9-SpRY | + | GCTTGGATCCATGTCTGATGGTTTTAGAGCTAGAAATAGCAAGTTAAAATAAGGCTAGTCCGTTATCAACTTGAAAAAGTGGCACCGAGTCGGTGCcttcCGAGTCTTCCACTGCACACAGTACATCAGACATGgatc | 29550 | TCTTCTTTTCATCCCAGCTTGTTTTAGAGCTAGAAATAGCAAGTTAAAATAAGGCTAGTCCGTTATCAACTTGAAAAAGTGGCACCGAGTCGGTGC | 29727 |
| 306 | SpyCas9-SpRY | - | CCTGCTTTCCTCTCGGGATTGTTTTAGAGCTAGAAATAGCAAGTTAAAATAAGGCTAGTCCGTTATCAACTTGAAAAAGTGGCACCGAGTCGGTGCagacTCGGAAGGCCAGGCCACCCAAGAAATCCCGAGAGgaaa | 29551 | CTGGCAACTGGTAGCTGGAGGTTTTAGAGCTAGAAATAGCAAGTTAAAATAAGGCTAGTCCGTTATCAACTTGAAAAAGTGGCACCGAGTCGGTGC | 29728 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 308 | SpyCas9-SpRY | + | GGCTTGGATCCATGTCTGATGTTTTAGAGCTAGAAATAGCAAGTTAAAATAAGGCTAGTCCGTTATCAACTTGAAAAAGTGGCACCGAGTCGGTGCttcCGAGTCTTCCACTGCACACAGTACATCAGACATGGatcc | 29552 | CTTCTTTTCATCCCAGCTTGGTTTTAGAGCTAGAAATAGCAAGTTAAAATAAGGCTAGTCCGTTATCAACTTGAAAAAGTGGCACCGAGTCGGTGC | 29729 |
| 309 | SpyCas9-SpRY | - | GCCTGCTTTCCTCTCGGGATGTTTTAGAGCTAGAAATAGCAAGTTAAAATAAGGCTAGTCCGTTATCAACTTGAAAAAGTGGCACCGAGTCGGTGCgacTCGGAAGGCCAGGCCACCCAAGAAATCCCGAGAGGaaag | 29553 | TGGCAACTGGTAGCTGGAGGGTTTTAGAGCTAGAAATAGCAAGTTAAAATAAGGCTAGTCCGTTATCAACTTGAAAAAGTGGCACCGAGTCGGTGC | 29730 |
| 310 | SpyCas9-NG | + | GGGCTTGGATCCATGTCTGAGTTTTAGAGCTAGAAATAGCAAGTTAAAATAAGGCTAGTCCGTTATCAACTTGAAAAAGTGGCACCGAGTCGGTGCtcCGAGTCTTCCACTGCACACAGTACATCAGACATGGAtcca | 29554 | CTTTTCATCCCAGCTTGCACGTTTTAGAGCTAGAAATAGCAAGTTAAAATAAGGCTAGTCCGTTATCAACTTGAAAAAGTGGCACCGAGTCGGTGC | 29731 |
| 314 | SpyCas9-SpRY | + | GGGCTTGGATCCATGTCTGAGTTTTAGAGCTAGAAATAGCAAGTTAAAATAAGGCTAGTCCGTTATCAACTTGAAAAAGTGGCACCGAGTCGGTGCtcCGAGTCTTCCACTGCACACAGTACATCAGACATGGAtcca | 29555 | TTCTTTTCATCCCAGCTTGCGTTTTAGAGCTAGAAATAGCAAGTTAAAATAAGGCTAGTCCGTTATCAACTTGAAAAAGTGGCACCGAGTCGGTGC | 29732 |
| 315 | SpyCas9-SpRY | - | GGCCTGCTTTCCTCTCGGGAGTTTTAGAGCTAGAAATAGCAAGTTAAAATAAGGCTAGTCCGTTATCAACTTGAAAAAGTGGCACCGAGTCGGTGCacTCGGAAGGCCAGGCCACCCAAGAAATCCCGAGAGGAaagc | 29556 | GGCAACTGGTAGCTGGAGGAGTTTTAGAGCTAGAAATAGCAAGTTAAAATAAGGCTAGTCCGTTATCAACTTGAAAAAGTGGCACCGAGTCGGTGC | 29733 |
| 316 | BlatCas9 | + | catgGGCTTGGATCCATGTCTGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTtcCGAGTCTTCCACTGCACACAGTACATCAGACATGGAtcca | 29557 | tcttTCTTCTTTTCATCCCAGCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29734 |
| 317 | BlatCas9 | + | catgGGCTTGGATCCATGTCTGAGCTATAGTTCCTTACTGAAAGGTAAGTTGCTATAGTAAG | 29558 | tcttTCTTCTTTTCATCCCAGCTGCTATAGTTCCTTACTGAAAGGTAAGTTGCTATAGTAAGGGCAACAGACCCGA | 29735 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | GGCAACAGACCCGAGGCGTTGGGGATCGCC TAGCCCGTGTTTACGGGCTCTCCCCATATTC AAAATAATGACAGACGAGCACCTTGGAGCA TTTATCTCCGAGGTGCTtcCGAGTCTTCCACT GCACACAGTACATCAGACATGGAtcca | | GGCGTTGGGGATCGCCTAGCCCGTGTTTACGGGCTCT CCCCATATTCAAAATAATGACAGACGAGCACCTTGGA GCATTTATCTCCGAGGTGCT | |
| 321 | ScaCas9-Sc++ | + | TGGGCTTGGATCCATGTCTGGTTTTAGAGCT AGAAATAGCAAGTTAAAATAAGGCTAGTCC GTTATCAACTTGAAAAAGTGGCACCGAGTC GGTGCcCGAGTCTTCCACTGCACACAGTACA TCAGACATGGATccaa | 29559 | TCTTTTCATCCCAGCTTGCAGTTTTAGAGCTAGAAATA GCAAGTTAAAATAAGGCTAGTCCGTTATCAACTTGAA AAAGTGGCACCGAGTCGGTGC | 29736 |
| 322 | SpyCas9-SpRY | + | TGGGCTTGGATCCATGTCTGGTTTTAGAGCT AGAAATAGCAAGTTAAAATAAGGCTAGTCC GTTATCAACTTGAAAAAGTGGCACCGAGTC GGTGCcCGAGTCTTCCACTGCACACAGTACA TCAGACATGGATccaa | 29560 | TCTTTTCATCCCAGCTTGCAGTTTTAGAGCTAGAAATA GCAAGTTAAAATAAGGCTAGTCCGTTATCAACTTGAA AAAGTGGCACCGAGTCGGTGC | 29737 |
| 323 | SpyCas9-SpRY | - | TGGCCTGCTTTCCTCTCGGGGTTTTAGAGCT AGAAATAGCAAGTTAAAATAAGGCTAGTCC GTTATCAACTTGAAAAAGTGGCACCGAGTC GGTGCcTCGGAAGGCCAGGCCACCCAAGAA ATCCCGAGAGGAAagca | 29561 | GCAACTGGTAGCTGGAGGACGTTTTAGAGCTAGAAAT AGCAAGTTAAAATAAGGCTAGTCCGTTATCAACTTGA AAAAGTGGCACCGAGTCGGTGC | 29738 |
| 324 | BlatCas9 | - | ggctGGCCTGCTTTCCTCTCGGGGCTATAGTT CCTTACTGAAAGGTAAGTTGCTATAGTAAG GGCAACAGACCCGAGGCGTTGGGGATCGCC TAGCCCGTGTTTACGGGCTCTCCCCATATTC AAAATAATGACAGACGAGCACCTTGGAGCA TTTATCTCCGAGGTGCTcTCGGAAGGCCAGG CCACCCAAGAAATCCCGAGAGGAAagca | 29562 | ctggCAACTGGTAGCTGGAGGACGCTATAGTTCCTTACT GAAAGGTAAGTTGCTATAGTAAGGGCAACAGACCCG AGGCGTTGGGGATCGCCTAGCCCGTGTTTACGGGCTC TCCCCATATTCAAAATAATGACAGACGAGCACCTTGG AGCATTTATCTCCGAGGTGCT | 29739 |
| 325 | BlatCas9 | - | ggctGGCCTGCTTTCCTCTCGGGGCTATAGTT CCTTACTGAAAGGTAAGTTGCTATAGTAAG GGCAACAGACCCGAGGCGTTGGGGATCGCC TAGCCCGTGTTTACGGGCTCTCCCCATATTC AAAATAATGACAGACGAGCACCTTGGAGCA TTTATCTCCGAGGTGCTcTCGGAAGGCCAGG CCACCCAAGAAATCCCGAGAGGAAagca | 29563 | ctggCAACTGGTAGCTGGAGGACGCTATAGTTCCTTACT GAAAGGTAAGTTGCTATAGTAAGGGCAACAGACCCG AGGCGTTGGGGATCGCCTAGCCCGTGTTTACGGGCTC TCCCCATATTCAAAATAATGACAGACGAGCACCTTGG AGCATTTATCTCCGAGGTGCT | 29740 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 327 | SpyCas9-SpRY | + | ATGGGCTTGGATCCATGTCTGTTTTAGAGCTAGAAATAGCAAGTTAAAATAAGGCTAGTCCGTTATCAACTTGAAAAAGTGGCACCGAGTCGGTGCCGAGTCTTCCACTGCACACAGTACATCAGACATGGATCcaag | 29564 | CTTTTCATCCCAGCTTGCACGTTTTAGAGCTAGAAATAGCAAGTTAAAATAAGGCTAGTCCGTTATCAACTTGAAAAAGTGGCACCGAGTCGGTGC | 29741 |
| 329 | SpyCas9-SpRY | - | CTGGCCTGCTTTCCTCTCGGGTTTTAGAGCTAGAAATAGCAAGTTAAAATAAGGCTAGTCCGTTATCAACTTGAAAAAGTGGCACCGAGTCGGTGCTCGGAAGGCCAGGCCACCCAAGAAATCCCGAGAGGAAAgcag | 29565 | CAACTGGTAGCTGGAGGACAGTTTTAGAGCTAGAAATAGCAAGTTAAAATAAGGCTAGTCCGTTATCAACTTGAAAAAGTGGCACCGAGTCGGTGC | 29742 |
| 332 | SpyCas9-NG | + | CATGGGCTTGGATCCATGTCGTTTTAGAGCTAGAAATAGCAAGTTAAAATAAGGCTAGTCCGTTATCAACTTGAAAAAGTGGCACCGAGTCGGTGCGAGTCTTCCACTGCACACAGTACATCAGACATGGATCCaagc | 29566 | TTTTCATCCCAGCTTGCACTGTTTTAGAGCTAGAAATAGCAAGTTAAAATAAGGCTAGTCCGTTATCAACTTGAAAAAGTGGCACCGAGTCGGTGC | 29743 |
| 335 | SpyCas9-NG | - | GCTGGCCTGCTTTCCTCTCGGTTTTAGAGCTAGAAATAGCAAGTTAAAATAAGGCTAGTCCGTTATCAACTTGAAAAAGTGGCACCGAGTCGGTGCCGGAAGGCCAGGCCACCCAAGAAATCCCGAGAGGAAAGcagg | 29567 | GCAACTGGTAGCTGGAGGACGTTTTAGAGCTAGAAATAGCAAGTTAAAATAAGGCTAGTCCGTTATCAACTTGAAAAAGTGGCACCGAGTCGGTGC | 29744 |
| 339 | SpyCas9-SpRY | + | CATGGGCTTGGATCCATGTCGTTTTAGAGCTAGAAATAGCAAGTTAAAATAAGGCTAGTCCGTTATCAACTTGAAAAAGTGGCACCGAGTCGGTGCGAGTCTTCCACTGCACACAGTACATCAGACATGGATCCaagc | 29568 | TTTTCATCCCAGCTTGCACTGTTTTAGAGCTAGAAATAGCAAGTTAAAATAAGGCTAGTCCGTTATCAACTTGAAAAAGTGGCACCGAGTCGGTGC | 29745 |
| 341 | SpyCas9-SpRY | - | GCTGGCCTGCTTTCCTCTCGGTTTTAGAGCTAGAAATAGCAAGTTAAAATAAGGCTAGTCCGTTATCAACTTGAAAAAGTGGCACCGAGTCGGTGCCGGAAGGCCAGGCCACCCAAGAAATCCCGAGAGGAAAGcagg | 29569 | AACTGGTAGCTGGAGGACAGGTTTTAGAGCTAGAAATAGCAAGTTAAAATAAGGCTAGTCCGTTATCAACTTGAAAAAGTGGCACCGAGTCGGTGC | 29746 |
| 350 | ScaCas9-Sc++ | + | ACATGGGCTTGGATCCATGTGTTTTAGAGCTAGAAATAGCAAGTTAAAATAAGGCTAGTCCGTTATCAACTTGAAAAAGTGGCACCGAGTCGGTGCAGTCTTCCACTGCACACAGTACATCAGACATGGATCCAagcc | 29570 | CTTTTCATCCCAGCTTGCACGTTTTAGAGCTAGAAATAGCAAGTTAAAATAAGGCTAGTCCGTTATCAACTTGAAAAAGTGGCACCGAGTCGGTGC | 29747 |

TABLE 4B-continued

Exemplary template RNA sequences and second nick gRNA spacer sequences
Table 4B provides design of RNA components of gene modifying systems for correcting the pathogenic R261Q, mutation in PAH. The gRNA spacers from Table 1B were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 351 | SpyCas9-SpRY | + | ACATGGGCTTGGATCCATGTGTTTTAGAGCTAGAAATAGCAAGTTAAAATAAGGCTAGTCCGTTATCAACTTGAAAAAGTGGCACCGAGTCGGTGCAGTCTTCCACTGCACACAGTACATCAGACATGGATCCAagcc | 29571 | TTTCATCCCAGCTTGCACTGGTTTTAGAGCTAGAAATAGCAAGTTAAAATAAGGCTAGTCCGTTATCAACTTGAAAAAGTGGCACCGAGTCGGTGC | 29748 |
| 354 | ScaCas9-Sc++ | - | GGCTGGCCTGCTTTCCTCTCGTTTTAGAGCTAGAAATAGCAAGTTAAAATAAGGCTAGTCCGTTATCAACTTGAAAAAGTGGCACCGAGTCGGTGCGGAAGGCCAGGCCACCCAAGAAATCCCGAGAGGAAAGCaggc | 29572 | GTAGCTGGAGGACAGTACTCGTTTTAGAGCTAGAAATAGCAAGTTAAAATAAGGCTAGTCCGTTATCAACTTGAAAAAGTGGCACCGAGTCGGTGC | 29749 |
| 355 | SpyCas9 | - | GGCTGGCCTGCTTTCCTCTCGTTTTAGAGCTAGAAATAGCAAGTTAAAATAAGGCTAGTCCGTTATCAACTTGAAAAAGTGGCACCGAGTCGGTGCGGAAGGCCAGGCCACCCAAGAAATCCCGAGAGGAAAGCaggc | 29573 | TAGCTGGAGGACAGTACTCAGTTTTAGAGCTAGAAATAGCAAGTTAAAATAAGGCTAGTCCGTTATCAACTTGAAAAAGTGGCACCGAGTCGGTGC | 29750 |
| 358 | SpyCas9-SpRY | - | GGCTGGCCTGCTTTCCTCTCGTTTTAGAGCTAGAAATAGCAAGTTAAAATAAGGCTAGTCCGTTATCAACTTGAAAAAGTGGCACCGAGTCGGTGCGGAAGGCCAGGCCACCCAAGAAATCCCGAGAGGAAAGCaggc | 29574 | ACTGGTAGCTGGAGGACAGTGTTTTAGAGCTAGAAATAGCAAGTTAAAATAAGGCTAGTCCGTTATCAACTTGAAAAAGTGGCACCGAGTCGGTGC | 29751 |
| 359 | SpyCas9-NG | - | GGCTGGCCTGCTTTCCTCTCGTTTTAGAGCTAGAAATAGCAAGTTAAAATAAGGCTAGTCCGTTATCAACTTGAAAAAGTGGCACCGAGTCGGTGCGGAAGGCCAGGCCACCCAAGAAATCCCGAGAGGAAAGCaggc | 29575 | GCAACTGGTAGCTGGAGGACGTTTTAGAGCTAGAAATAGCAAGTTAAAATAAGGCTAGTCCGTTATCAACTTGAAAAAGTGGCACCGAGTCGGTGC | 29752 |

TABLE 4C

Exemplary template RNA sequences and second nick gRNA spacer sequences

Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 3 | ScaCas9-Sc++ | - | CACTGGTTTCCGCCTCCAACGTTTTAGAGCTAGAAATAGCAAGTTAAAATAAGGCTAGTCCGTTATCAACTTGAAAAAGTGGCACCGAGTCGGTGCcccgagaggaaagcaggccagccacaggTCGGAGGCGGaaac | 29753 | CACGGTTCGGGGGTATACATGTTTTAGAGCTAGAAATAGCAAGTTAAAATAAGGCTAGTCCGTTATCAACTTGAAAAAGTGGCACCGAGTCGGTGC | 29938 |
| 4 | SpyCas9-SpRY | - | CACTGGTTTCCGCCTCCAACGTTTTAGAGCTAGAAATAGCAAGTTAAAATAAGGCTAGTCCGTTATCAACTTGAAAAAGTGGCACCGAGTCGGTGCcccgagaggaaagcaggccagccacaggTCGGAGGCGGaaac | 29754 | ACGGTTCGGGGGTATACATGGTTTTAGAGCTAGAAATAGCAAGTTAAAATAAGGCTAGTCCGTTATCAACTTGAAAAAGTGGCACCGAGTCGGTGC | 29939 |
| 5 | SauriCas9 | + | AAGCAGGCCAGCCACAGGTTGGTTTTAGTACTCTGGAAACAGAATCTACTAAAACAAGGCAAAATGCCGTGTTTATCTCGTCAACTTGTTGGCGAGAatcccagcttgcactggtttccgcctcCGACCTGTGGCtggc | 29755 | TGTGTACTACTCCACTACCTAGTTTTAGTACTCTGGAAACAGAATCTACTAAAACAAGGCAAAATGCCGTGTTTATCTCGTCAACTTGTTGGCGAGA | 29940 |
| 6 | SauriCas9-KKH | + | AAGCAGGCCAGCCACAGGTTGGTTTTAGTACTCTGGAAACAGAATCTACTAAAACAAGGCAAAATGCCGTGTTTATCTCGTCAACTTGTTGGCGAGAatcccagcttgcactggtttccgcctcCGACCTGTGGCtggc | 29756 | ATGTGTACTACTCCACTACCTGTTTTAGTACTCTGGAAACAGAATCTACTAAAACAAGGCAAAATGCCGTGTTTATCTCGTCAACTTGTTGGCGAGA | 29941 |
| 9 | ScaCas9-Sc++ | + | AGCAGGCCAGCCACAGGTTGGTTTTAGAGCTAGAAATAGCAAGTTAAAATAAGGCTAGTCCGTTATCAACTTGAAAAAGTGGCACCGAGTCGGTGCatcccagcttgcactggtttccgcctcCGACCTGTGGCtggc | 29757 | GTGTACTACTCCACTACCTAGTTTTAGAGCTAGAAATAGCAAGTTAAAATAAGGCTAGTCCGTTATCAACTTGAAAAAGTGGCACCGAGTCGGTGC | 29942 |
| 10 | SpyCas9-SpRY | + | AGCAGGCCAGCCACAGGTTGGTTTTAGAGCTAGAAATAGCAAGTTAAAATAAGGCTAGTCCGTTATCAACTTGAAAAAGTGGCACCGAGTCGGTGCatcccagcttgcactggtttccgcctcCGACCTGTGGCtggc | 29758 | CAGTTATGTGTACTACTCCAGTTTTAGAGCTAGAAATAGCAAGTTAAAATAAGGCTAGTCCGTTATCAACTTGAAAAAGTGGCACCGAGTCGGTGC | 29943 |
| 11 | SpyCas9-SpRY | - | GCACTGGTTTCCGCCTCCAAGTTTTAGAGCTAGAAATAGCAAGTTAAAATAAGGCTAGTCCGTTATCAACTTGAAAAAGTGGCACCGAGTCGGTGCccgagaggaaagcaggccagccacaggTCGGAGGCGGAaacc | 29759 | CGGTTCGGGGGTATACATGGGTTTTAGAGCTAGAAATAGCAAGTTAAAATAAGGCTAGTCCGTTATCAACTTGAAAAAGTGGCACCGAGTCGGTGC | 29944 |
| 12 | BlatCas9 | + | gaaaGCAGGCCAGCCACAGGTTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCT | 29760 | gggcAGTTATGTGTACTACTCCAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAAT | 29945 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | TGGAGCATTTATCTCCGAGGTGCTatcccagcttgcactggtttcc gcctcCGACCTGTGGCtggc | | GACAGACGAGCACCTTGGAGCATTTATCTCCG AGGTGCT | |
| 13 | BlatCas9 | + | gaaaGCAGGCCAGCCACAGGTTGGCTATAGTTCCTTAC TGAAAGGTAAGTTGCTATAGTAAGGGCAACAGACCC GAGGCGTTGGGGATCGCCTAGCCCGTGTTTACGGGC TCTCCCCATATTCAAAATAATGACAGACGAGCACCT TGGAGCATTTATCTCCGAGGTGCTatcccagcttgcactggtttcc gcctcCGACCTGTGGCtggc | 29761 | gggcAGTTATGTGTACTACTCCAGCTATAGTTCC TTACTGAAAGGTAAGTTGCTATAGTAAGGGCA ACAGACCCGAGGCGTTGGGGATCGCCTAGCCC GTGTTTACGGGCTCTCCCCATATTCAAAATAAT GACAGACGAGCACCTTGGAGCATTTATCTCCG AGGTGCT | 29946 |
| 14 | SauCas9KKH | + | AAAGCAGGCCAGCCACAGGTTGTTTTAGTACTCTGG AAACAGAATCTACTAAAACAAGGCAAAATGCCGTGT TTATCTCGTCAACTTGTTGGCGAGAtcccagcttgcactggtttc cgcctcCGACCTGTGGCTggcc | 29762 | GTTATGTGTACTACTCCACTAGTTTTAGTACTC TGGAAACAGAATCTACTAAAACAAGGCAAAAT GCCGTGTTTATCTCGTCAACTTGTTGGCGAGA | 29947 |
| 15 | SauriCas9-KKH | + | AAAGCAGGCCAGCCACAGGTTGTTTTAGTACTCTGG AAACAGAATCTACTAAAACAAGGCAAAATGCCGTGT TTATCTCGTCAACTTGTTGGCGAGAtcccagcttgcactggtttc cgcctcCGACCTGTGGCTggcc | 29763 | ATGTGTACTACTCCACTACCTGTTTTAGTACTC TGGAAACAGAATCTACTAAAACAAGGCAAAAT GCCGTGTTTATCTCGTCAACTTGTTGGCGAGA | 29948 |
| 17 | SpyCas9-NG | + | AAGCAGGCCAGCCACAGGTTGTTTTAGAGCTAGAAA TAGCAAGTTAAAATAAGGCTAGTCCGTTATCAACTT GAAAAAGTGGCACCGAGTCGGTGCTcccagcttgcactggtttc cgcctcCGACCTGTGGCTggcc | 29764 | TGTACTACTCCACTACCTAAGTTTTAGAGCTAG AAATAGCAAGTTAAAATAAGGCTAGTCCGTTA TCAACTTGAAAAAGTGGCACCGAGTCGGTGC | 29949 |
| 21 | SpyCas9-SpRY | + | AAGCAGGCCAGCCACAGGTTGTTTTAGAGCTAGAAA TAGCAAGTTAAAATAAGGCTAGTCCGTTATCAACTT GAAAAAGTGGCACCGAGTCGGTGCTcccagcttgcactggtttc cgcctcCGACCTGTGGCTggcc | 29765 | AGTTATGTGTACTACTCCACGTTTTAGAGCTAG AAATAGCAAGTTAAAATAAGGCTAGTCCGTTA TCAACTTGAAAAAGTGGCACCGAGTCGGTGC | 29950 |
| 22 | SpyCas9-SpRY | - | TGCACTGGTTTCCGCCTCCAGTTTTAGAGCTAGAAAT AGCAAGTTAAAATAAGGCTAGTCCGTTATCAACTTG AAAAAGTGGCACCGAGTCGGTGCcgagaggaaagcaggccag ccacaggTCGGAGGCGGAAacca | 29766 | GGTTCGGGGGTATACATGGGGTTTTAGAGCTA GAAATAGCAAGTTAAAATAAGGCTAGTCCGTT ATCAACTTGAAAAAGTGGCACCGAGTCGGTGC | 29951 |
| 25 | SauCas9 | + | agGAAAGCAGGCCAGCCACAGGTGTTTTAGTACTCTG GAAACAGAATCTACTAAAACAAGGCAAAATGCCGT GTTTATCTCGTCAACTTGTTGGCGAGAcccagcttgcactggt ttccgcctcCGACCTGTGGCTGgcct | 29767 | gcCTAGCGTCAAAGCCTATGTCCGTTTTAGTAC TCTGGAAACAGAATCTACTAAAACAAGGCAAA ATGCCGTGTTTATCTCGTCAACTTGTTGGCGAG A | 29952 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 26 | SauCas9KKH | + | GAAAGCAGGCCAGCCACAGGTGTTTTAGTACTCTGGAAACAGAATCTACTAAAACAAGGCAAAATGCCGTGTTTATCTCGTCAACTTGTTGGCGAGAcccagcttgcactggtttccgcctcCGACCTGTGGCTGgcct | 29768 | GTTATGTGTACTACTCCACTAGTTTTAGTACTCTGGAAACAGAATCTACTAAAACAAGGCAAAATGCCGTGTTTATCTCGTCAACTTGTTGGCGAGA | 29953 |
| 29 | ScaCas9-Sc++ | + | AAAGCAGGCCAGCCACAGGTGTTTTAGAGCTAGAAATAGCAAGTTAAAATAAGGCTAGTCCGTTATCAACTTGAAAAAGTGGCACCGAGTCGGTGCcccagcttgcactggtttccgcctcCGACCTGTGGCTGgcct | 29769 | GTGTACTACTCCACTACCTAGTTTTAGAGCTAGAAATAGCAAGTTAAAATAAGGCTAGTCCGTTATCAACTTGAAAAAGTGGCACCGAGTCGGTGC | 29954 |
| 30 | SpyCas9 | + | AAAGCAGGCCAGCCACAGGTGTTTTAGAGCTAGAAATAGCAAGTTAAAATAAGGCTAGTCCGTTATCAACTTGAAAAAGTGGCACCGAGTCGGTGCcccagcttgcactggtttccgcctcCGACCTGTGGCTGgcct | 29770 | TGTACTACTCCACTACCTAAGTTTTAGAGCTAGAAATAGCAAGTTAAAATAAGGCTAGTCCGTTATCAACTTGAAAAAGTGGCACCGAGTCGGTGC | 29955 |
| 33 | SpyCas9-SpRY | + | AAAGCAGGCCAGCCACAGGTGTTTTAGAGCTAGAAATAGCAAGTTAAAATAAGGCTAGTCCGTTATCAACTTGAAAAAGTGGCACCGAGTCGGTGCcccagcttgcactggtttccgcctcCGACCTGTGGCTGgcct | 29771 | GTTATGTGTACTACTCCACTGTTTTAGAGCTAGAAATAGCAAGTTAAAATAAGGCTAGTCCGTTATCAACTTGAAAAAGTGGCACCGAGTCGGTGC | 29956 |
| 34 | SpyCas9-NG | + | AAAGCAGGCCAGCCACAGGTGTTTTAGAGCTAGAAATAGCAAGTTAAAATAAGGCTAGTCCGTTATCAACTTGAAAAAGTGGCACCGAGTCGGTGCcccagcttgcactggtttccgcctcCGACCTGTGGCTGgcct | 29772 | TGTACTACTCCACTACCTAAGTTTTAGAGCTAGAAATAGCAAGTTAAAATAAGGCTAGTCCGTTATCAACTTGAAAAAGTGGCACCGAGTCGGTGC | 29957 |
| 37 | SpyCas9-SpRY | - | TTGCACTGGTTTCCGCCTCCGTTTTAGAGCTAGAAATAGCAAGTTAAAATAAGGCTAGTCCGTTATCAACTTGAAAAAGTGGCACCGAGTCGGTGCgagaggaaagcaggccagccacaggTCGGAGGCGGAAAccag | 29773 | GTTCGGGGGTATACATGGGCGTTTTAGAGCTAGAAATAGCAAGTTAAAATAAGGCTAGTCCGTTATCAACTTGAAAAAGTGGCACCGAGTCGGTGC | 29958 |
| 42 | SauCas9 | + | gaGGAAAGCAGGCCAGCCACAGGGTTTTAGTACTCTGGAAACAGAATCTACTAAAACAAGGCAAAATGCCGTGTTTATCTCGTCAACTTGTTGGCGAGAccagcttgcactggtttccgcctcCGACCTGTGGCTGGcctg | 29774 | gcCTAGCGTCAAAGCCTATGTCCGTTTTAGTACTCTGGAAACAGAATCTACTAAAACAAGGCAAAATGCCGTGTTTATCTCGTCAACTTGTTGGCGAGA | 29959 |
| 43 | SauCas9KKH | + | GGAAAGCAGGCCAGCCACAGGGTTTTAGTACTCTGGAAACAGAATCTACTAAAACAAGGCAAAATGCCGTGTTTATCTCGTCAACTTGTTGGCGAGAccagcttgcactggtttccgcctcCGACCTGTGGCTGGcctg | 29775 | GTTATGTGTACTACTCCACTAGTTTTAGTACTCTGGAAACAGAATCTACTAAAACAAGGCAAAATGCCGTGTTTATCTCGTCAACTTGTTGGCGAGA | 29960 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 44 | SauriCas9 | + | GGAAAGCAGGCCAGCCACAGGGTTTTAGTACTCTGGAAACAGAATCTACTAAAACAAGGCAAAATGCCGTGTTTATCTCGTCAACTTGTTGGCGAGAccagcttgcactggtttccgcctcCGACCTGTGGCTGGcctg | 29776 | TGTGTACTACTCCACTACCTAGTTTTAGTACTCTGGAAACAGAATCTACTAAAACAAGGCAAAATGCCGTGTTTATCTCGTCAACTTGTTGGCGAGA | 29961 |
| 45 | SauriCas9-KKH | + | GGAAAGCAGGCCAGCCACAGGGTTTTAGTACTCTGGAAACAGAATCTACTAAAACAAGGCAAAATGCCGTGTTTATCTCGTCAACTTGTTGGCGAGAccagcttgcactggtttccgcctcCGACCTGTGGCTGGcctg | 29777 | ATGTGTACTACTCCACTACCTGTTTTAGTACTCTGGAAACAGAATCTACTAAAACAAGGCAAAATGCCGTGTTTATCTCGTCAACTTGTTGGCGAGA | 29962 |
| 48 | ScaCas9-Sc++ | + | GAAAGCAGGCCAGCCACAGGGTTTTAGAGCTAGAAATAGCAAGTTAAAATAAGGCTAGTCCGTTATCAACTTGAAAAAGTGGCACCGAGTCGGTGCccagcttgcactggtttccgcctcCGACCTGTGGCTGGcctg | 29778 | GTGTACTACTCCACTACCTAGTTTTAGAGCTAGAAATAGCAAGTTAAAATAAGGCTAGTCCGTTATCAACTTGAAAAAGTGGCACCGAGTCGGTGC | 29963 |
| 49 | SpyCas9-SpRY | + | GAAAGCAGGCCAGCCACAGGGTTTTAGAGCTAGAAATAGCAAGTTAAAATAAGGCTAGTCCGTTATCAACTTGAAAAAGTGGCACCGAGTCGGTGCccagcttgcactggtttccgcctcCGACCTGTGGCTGGcctg | 29779 | TTATGTGTACTACTCCACTAGTTTTAGAGCTAGAAATAGCAAGTTAAAATAAGGCTAGTCCGTTATCAACTTGAAAAAGTGGCACCGAGTCGGTGC | 29964 |
| 50 | SpyCas9-SpRY | - | CTTGCACTGGTTTCCGCCTCGTTTTAGAGCTAGAAATAGCAAGTTAAAATAAGGCTAGTCCGTTATCAACTTGAAAAAGTGGCACCGAGTCGGTGCagaggaaagcaggccagccacaggTCGGAGGCGGAAACcagt | 29780 | TTCGGGGGTATACATGGGCTGTTTTAGAGCTAGAAATAGCAAGTTAAAATAAGGCTAGTCCGTTATCAACTTGAAAAAGTGGCACCGAGTCGGTGC | 29965 |
| 51 | BlatCas9 | - | cagcTTGCACTGGTTTCCGCCTCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTagaggaaagcaggccagccacaggTCGGAGGCGGAAACcagt | 29781 | ggttCGGGGGTATACATGGGCTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29966 |
| 52 | BlatCas9 | - | cagcTTGCACTGGTTTCCGCCTCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTagaggaaagcaggccagccacaggTCGGAGGCGGAAACcagt | 29782 | ggttCGGGGGTATACATGGGCTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29967 |
| 57 | Nme2Cas9 | - | ccCAGCTTGCACTGGTTTCCGCCTGTTGTAGCTCCCTTTCTCATTTCGGAAACGAAATGAGAACCGTTGCTACA | 29783 | cgGTTCGGGGGTATACATGGGCTTGTTGTAGCTCCCTTTCTCATTTCGGAAACGAAATGAGAACC | 29968 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | ATAAGGCCGTCTGAAAAGATGTGCCGCAACGCTCTG CCCCTTAAAGCTTCTGCTTTAAGGGGCATCGTTTAgag gaaagcaggccagccacaggTCGGAGGCGGAAACCagtg | | GTTGCTACAATAAGGCCGTCTGAAAAGATGTG CCGCAACGCTCTGCCCCTTAAAGCTTCTGCTTT AAGGGGCATCGTTTA | |
| 58 | SauCas9KKH | + | AGGAAAGCAGGCCAGCCACAGGTTTTAGTACTCTGG AAACAGAATCTACTAAAACAAGGCAAAATGCCGTGT TTATCTCGTCAACTTGTTGGCGAGAcagcttgcactggtttccgc ctcCGACCTGTGGCTGGCctgc | 29784 | TTATGTGTACTACTCCACTACGTTTTAGTACTC TGGAAACAGAATCTACTAAAACAAGGCAAAAT GCCGTGTTTATCTCGTCAACTTGTTGGCGAGA | 29969 |
| 59 | SpyCas9-SpRY | + | GGAAAGCAGGCCAGCCACAGGTTTTAGAGCTAGAA ATAGCAAGTTAAAATAAGGCTAGTCCGTTATCAACT TGAAAAAGTGGCACCGAGTCGGTGCcagcttgcactggtttcc gcctcCGACCTGTGGCTGGCctgc | 29785 | TATGTGTACTACTCCACTACGTTTTAGAGCTAG AAATAGCAAGTTAAAATAAGGCTAGTCCGTTA TCAACTTGAAAAAGTGGCACCGAGTCGGTGC | 29970 |
| 60 | SpyCas9-SpRY | − | GCTTGCACTGGTTTCCGCCTGTTTTAGAGCTAGAAAT AGCAAGTTAAAATAAGGCTAGTCCGTTATCAACTTG AAAAAGTGGCACCGAGTCGGTGCgaggaaagcaggccagcca caggTCGGAGGCGGAAACCagtg | 29786 | TCGGGGGTATACATGGGCTTGTTTTAGAGCTA GAAATAGCAAGTTAAAATAAGGCTAGTCCGTT ATCAACTTGAAAAAGTGGCACCGAGTCGGTGC | 29971 |
| 61 | BlatCas9 | − | ccagCTTGCACTGGTTTCCGCCTGCTATAGTTCCTTACT GAAAGGTAAGTTGCTATAGTAAGGGCAACAGACCCG AGGCGTTGGGGATCGCCTAGCCCGTGTTTACGGGCT CTCCCCATATTCAAAATAATGACAGACGAGCACCTT GGAGCATTTATCTCCGAGGTGCTgaggaaagcaggccagccac aggTCGGAGGCGGAAACCagtg | 29787 | ggttCGGGGGTATACATGGGCTTGCTATAGTTCC TTACTGAAAGGTAAGTTGCTATAGTAAGGGCA ACAGACCCGAGGCGTTGGGGATCGCCTAGCCC GTGTTTACGGGCTCTCCCCATATTCAAAATAAT GACAGACGAGCACCTTGGAGCATTTATCTCCG AGGTGCT | 29972 |
| 62 | BlatCas9 | − | ccagCTTGCACTGGTTTCCGCCTGCTATAGTTCCTTACT GAAAGGTAAGTTGCTATAGTAAGGGCAACAGACCCG AGGCGTTGGGGATCGCCTAGCCCGTGTTTACGGGCT CTCCCCATATTCAAAATAATGACAGACGAGCACCTT GGAGCATTTATCTCCGAGGTGCTgaggaaagcaggccagccac aggTCGGAGGCGGAAACCagtg | 29788 | ggttCGGGGGTATACATGGGCTTGCTATAGTTCC TTACTGAAAGGTAAGTTGCTATAGTAAGGGCA ACAGACCCGAGGCGTTGGGGATCGCCTAGCCC GTGTTTACGGGCTCTCCCCATATTCAAAATAAT GACAGACGAGCACCTTGGAGCATTTATCTCCG AGGTGCT | 29973 |
| 64 | SauCas9KKH | − | CAGCTTGCACTGGTTTCCGCCGTTTTAGTACTCTGGA AACAGAATCTACTAAAACAAGGCAAAATGCCGTGTT TATCTCGTCAACTTGTTGGCGAGAaggaaagcaggccagccac aggTCGGAGGCGGAAACCAgtgc | 29789 | GGTTCGGGGGTATACATGGGCGTTTTAGTACT CTGGAAACAGAATCTACTAAAACAAGGCAAA ATGCCGTGTTTATCTCGTCAACTTGTTGGCGAG A | 29974 |
| 65 | SpyCas9-NG | + | AGGAAAGCAGGCCAGCCACAGTTTTAGAGCTAGAA ATAGCAAGTTAAAATAAGGCTAGTCCGTTATCAACT | 29790 | TGTACTACTCCACTACCTAAGTTTTAGAGCTAG AAATAGCAAGTTAAAATAAGGCTAGTCCGTTA | 29975 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | TGAAAAAGTGGCACCGAGTCGGTGCagcttgcactggtttccgcctcCGACCTGTGGCTGGCCtgct | | TCAACTTGAAAAAGTGGCACCGAGTCGGTGC | |
| 69 | SpyCas9-SpRY | + | AGGAAAGCAGGCCAGCCACAGTTTTAGAGCTAGAAATAGCAAGTTAAAATAAGGCTAGTCCGTTATCAACTTGAAAAAGTGGCACCGAGTCGGTGCagcttgcactggtttccgcctcCGACCTGTGGCTGGCCtgct | 29791 | ATGTGTACTACTCCACTACCGTTTTAGAGCTAGAAATAGCAAGTTAAAATAAGGCTAGTCCGTTATCAACTTGAAAAAGTGGCACCGAGTCGGTGC | 29976 |
| 70 | SpyCas9-SpRY | - | AGCTTGCACTGGTTTCCGCCGTTTTAGAGCTAGAAATAGCAAGTTAAAATAAGGCTAGTCCGTTATCAACTTGAAAAAGTGGCACCGAGTCGGTGCaggaaagcaggccagccacaggTCGGAGGCGGAAACCAgtgc | 29792 | CGGGGGTATACATGGGCTTGGTTTTAGAGCTAGAAATAGCAAGTTAAAATAAGGCTAGTCCGTTATCAACTTGAAAAAGTGGCACCGAGTCGGTGC | 29977 |
| 76 | ScaCas9-Sc++ | + | GAGGAAAGCAGGCCAGCCACGTTTTAGAGCTAGAAATAGCAAGTTAAAATAAGGCTAGTCCGTTATCAACTTGAAAAAGTGGCACCGAGTCGGTGCgcttgcactggtttccgcctcCGACCTGTGGCTGGCCTgctt | 29793 | GTGTACTACTCCACTACCTAGTTTTAGAGCTAGAAATAGCAAGTTAAAATAAGGCTAGTCCGTTATCAACTTGAAAAAGTGGCACCGAGTCGGTGC | 29978 |
| 77 | SpyCas9 | + | GAGGAAAGCAGGCCAGCCACGTTTTAGAGCTAGAAATAGCAAGTTAAAATAAGGCTAGTCCGTTATCAACTTGAAAAAGTGGCACCGAGTCGGTGCgcttgcactggtttccgcctcCGACCTGTGGCTGGCCTgctt | 29794 | TGTACTACTCCACTACCTAAGTTTTAGAGCTAGAAATAGCAAGTTAAAATAAGGCTAGTCCGTTATCAACTTGAAAAAGTGGCACCGAGTCGGTGC | 29979 |
| 80 | SpyCas9-SpRY | + | GAGGAAAGCAGGCCAGCCACGTTTTAGAGCTAGAAATAGCAAGTTAAAATAAGGCTAGTCCGTTATCAACTTGAAAAAGTGGCACCGAGTCGGTGCgcttgcactggtttccgcctcCGACCTGTGGCTGGCCTgctt | 29795 | TGTGTACTACTCCACTACCTGTTTTAGAGCTAGAAATAGCAAGTTAAAATAAGGCTAGTCCGTTATCAACTTGAAAAAGTGGCACCGAGTCGGTGC | 29980 |
| 81 | SpyCas9-NG | + | GAGGAAAGCAGGCCAGCCACGTTTTAGAGCTAGAAATAGCAAGTTAAAATAAGGCTAGTCCGTTATCAACTTGAAAAAGTGGCACCGAGTCGGTGCgcttgcactggtttccgcctcCGACCTGTGGCTGGCCTgctt | 29796 | TGTACTACTCCACTACCTAAGTTTTAGAGCTAGAAATAGCAAGTTAAAATAAGGCTAGTCCGTTATCAACTTGAAAAAGTGGCACCGAGTCGGTGC | 29981 |
| 84 | SpyCas9-SpRY | - | CAGCTTGCACTGGTTTCCGCGTTTTAGAGCTAGAAATAGCAAGTTAAAATAAGGCTAGTCCGTTATCAACTTGAAAAAGTGGCACCGAGTCGGTGCggaaagcaggccagccacaggTCGGAGGCGGAAACCAGtgca | 29797 | GGGGGTATACATGGGCTTGGGTTTTAGAGCTAGAAATAGCAAGTTAAAATAAGGCTAGTCCGTTATCAACTTGAAAAAGTGGCACCGAGTCGGTGC | 29982 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 86 | SauriCas9 | + | GAGAGGAAAGCAGGCCAGCCAGTTTTAGTACTCTGGAAACAGAATCTACTAAAACAAGGCAAAATGCCGTGTTTATCTCGTCAACTTGTTGGCGAGActtgcactggtttccgcctcCGACCTGTGGCTGGCCTGcttt | 29798 | TGTGTACTACTCCACTACCTAGTTTTAGTACTCTGGAAACAGAATCTACTAAAACAAGGCAAAATGCCGTGTTTATCTCGTCAACTTGTTGGCGAGA | 29983 |
| 87 | SauriCas9-KKH | + | GAGAGGAAAGCAGGCCAGCCAGTTTTAGTACTCTGGAAACAGAATCTACTAAAACAAGGCAAAATGCCGTGTTTATCTCGTCAACTTGTTGGCGAGActtgcactggtttccgcctcCGACCTGTGGCTGGCCTGcttt | 29799 | TGTGTACTACTCCACTACCTAGTTTTAGTACTCTGGAAACAGAATCTACTAAAACAAGGCAAAATGCCGTGTTTATCTCGTCAACTTGTTGGCGAGA | 29984 |
| 90 | ScaCas9-Sc++ | + | AGAGGAAAGCAGGCCAGCCAGTTTTAGAGCTAGAAATAGCAAGTTAAAATAAGGCTAGTCCGTTATCAACTTGAAAAAGTGGCACCGAGTCGGTGCcttgcactggtttccgcctcCGACCTGTGGCTGGCCTGcttt | 29800 | GTGTACTACTCCACTACCTAGTTTTAGAGCTAGAAATAGCAAGTTAAAATAAGGCTAGTCCGTTATCAACTTGAAAAAGTGGCACCGAGTCGGTGC | 29985 |
| 91 | SpyCas9-SpRY | + | AGAGGAAAGCAGGCCAGCCAGTTTTAGAGCTAGAAATAGCAAGTTAAAATAAGGCTAGTCCGTTATCAACTTGAAAAAGTGGCACCGAGTCGGTGCcttgcactggtttccgcctcCGACCTGTGGCTGGCCTGcttt | 29801 | GTGTACTACTCCACTACCTAGTTTTAGAGCTAGAAATAGCAAGTTAAAATAAGGCTAGTCCGTTATCAACTTGAAAAAGTGGCACCGAGTCGGTGC | 29986 |
| 92 | SpyCas9-SpRY | - | CCAGCTTGCACTGGTTTCCGGTTTTAGAGCTAGAAATAGCAAGTTAAAATAAGGCTAGTCCGTTATCAACTTGAAAAAGTGGCACCGAGTCGGTGCgaaagcaggccagccacaggTCGGAGGCGGAAACCAGTgcaa | 29802 | GGGGTATACATGGGCTTGGAGTTTTAGAGCTAGAAATAGCAAGTTAAAATAAGGCTAGTCCGTTATCAACTTGAAAAAGTGGCACCGAGTCGGTGC | 29987 |
| 93 | BlatCaS9 | - | atccCAGCTTGCACTGGTTTCCGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTGaaagcaggccagccacaggTCGGAGGCGGAAACCAGTgcaa | 29803 | gttcGGGGGTATACATGGGCTTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29988 |
| 96 | Nme2Cas9 | - | tcATCCCAGCTTGCACTGGTTTCCGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAaaagcaggccagccacaggTCGGAGGCGGAAACCAGTGcaag | 29804 | cgGTTCGGGGGTATACATGGGCTTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 29989 |
| 97 | PpnCas9 | + | tccCGAGAGGAAAGCAGGCCAGCCGTTGTAGCTCCCTTTTTCATTTCGCGAAAGCGAAATGAAAAACGTTGTTACAATAAGAGATGAATTTCTCGCAAAGCTCTGCCTC | 29805 | ctaGCGTCAAAGCCTATGTCCCTGGTTGTAGCTCCCTTTTTCATTTCGCGAAAGCGAAATGAAAAACGTTGTTACAATAAGAGATGAATTTCTCGCAA | 29990 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | TTGAAATTTCGGTTTCAAGAGGCATCttgcactggtttccgcctcCGACCTGTGGCTGGCCTGCtttc | | AGCTCTGCCTCTTGAAATTTCGGTTTCAAGAGGCATC | |
| 98 | SauCas9KKH | + | CGAGAGGAAAGCAGGCCAGCCGTTTTAGTACTCTGGAAACAGAATCTACTAAAACAAGGCAAAATGCCGTGTTTATCTCGTCAACTTGTTGGCGAGAttgcactggtttccgcctcCGACCTGTGGCTGGCCTGCtttc | 29806 | ATGTGTACTACTCCACTACCTGTTTTAGTACTCTGGAAACAGAATCTACTAAAACAAGGCAAAATGCCGTGTTTATCTCGTCAACTTGTTGGCGAGA | 29991 |
| 99 | SauCas9KKH | + | CGAGAGGAAAGCAGGCCAGCCGTTTTAGTACTCTGGAAACAGAATCTACTAAAACAAGGCAAAATGCCGTGTTTATCTCGTCAACTTGTTGGCGAGAttgcactggtttccgcctcCGACCTGTGGCTGGCCTGCtttc | 29807 | ATGTGTACTACTCCACTACCTGTTTTAGTACTCTGGAAACAGAATCTACTAAAACAAGGCAAAATGCCGTGTTTATCTCGTCAACTTGTTGGCGAGA | 29992 |
| 102 | SauriCas9-KKH | + | CGAGAGGAAAGCAGGCCAGCCGTTTTAGTACTCTGGAAACAGAATCTACTAAAACAAGGCAAAATGCCGTGTTTATCTCGTCAACTTGTTGGCGAGAttgcactggtttccgcctcCGACCTGTGGCTGGCCTGCtttc | 29808 | TGTGTACTACTCCACTACCTAGTTTTAGTACTCTGGAAACAGAATCTACTAAAACAAGGCAAAATGCCGTGTTTATCTCGTCAACTTGTTGGCGAGA | 29993 |
| 103 | SpyCas9-SpRY | + | GAGAGGAAAGCAGGCCAGCCGTTTTAGAGCTAGAAATAGCAAGTTAAAATAAGGCTAGTCCGTTATCAACTTGAAAAAGTGGCACCGAGTCGGTGCttgcactggtttccgcctcCGACCTGTGGCTGGCCTGCtttc | 29809 | TGTACTACTCCACTACCTAAGTTTTAGAGCTAGAAATAGCAAGTTAAAATAAGGCTAGTCCGTTATCAACTTGAAAAAGTGGCACCGAGTCGGTGC | 29994 |
| 104 | SpyCas9-SpRY | - | CCCAGCTTGCACTGGTTTCCGTTTTAGAGCTAGAAATAGCAAGTTAAAATAAGGCTAGTCCGTTATCAACTTGAAAAAGTGGCACCGAGTCGGTGCaaagcaggccagccacaggTCGGAGGCGGAAACCAGTGcaag | 29810 | GGGTATACATGGGCTTGGATGTTTTAGAGCTAGAAATAGCAAGTTAAAATAAGGCTAGTCCGTTATCAACTTGAAAAAGTGGCACCGAGTCGGTGC | 29995 |
| 105 | BlatCas9 | - | catcCCAGCTTGCACTGGTTTCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTaaagcaggccagccacaggTCGGAGGCGGAAACCAGTGcaag | 29811 | ggggTATACATGGGCTTGGATCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29996 |
| 106 | BlatCas9 | - | catcCCAGCTTGCACTGGTTTCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTaaagcaggccagccacaggTCGGAGGCGGAAACCAGTGcaag | 29812 | ggggTATACATGGGCTTGGATCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29997 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 107 | BlatCas9 | - | catcCCAGCTTGCACTGGTTTCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTaaagcaggccagccacaggTCGGAGGCGGAAACCAGTGCaag | 29813 | ggggTATACATGGGCTTGGATCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 29998 |
| 108 | SauCas9KKH | + | CCGAGAGGAAAGCAGGCCAGCGTTTTAGTACTCTGGAAACAGAATCTACTAAAACAAGGCAAAATGCCGTGTTTATCTCGTCAACTTGTTGGCGAGAtgcactggtttccgcctcCGACCTGTGGCTGGCCTGCTTtcc | 29814 | ATGTGTACTACTCCACTACCTGTTTTAGTACTCTGGAAACAGAATCTACTAAAACAAGGCAAAATGCCGTGTTTATCTCGTCAACTTGTTGGCGAGA | 29999 |
| 109 | SpyCas9-NG | - | TCCCAGCTTGCACTGGTTTCGTTTTAGAGCTAGAAATAGCAAGTTAAAATAAGGCTAGTCCGTTATCAACTTGAAAAAGTGGCACCGAGTCGGTGCaagcaggccagccacaggTCGGAGGCGGAAACCAGTGCaagc | 29815 | TATACATGGGCTTGGATCCAGTTTTAGAGCTAGAAATAGCAAGTTAAAATAAGGCTAGTCCGTTATCAACTTGAAAAAGTGGCACCGAGTCGGTGC | 30000 |
| 112 | SpyCas9-SpRY | + | CGAGAGGAAAGCAGGCCAGCGTTTTAGAGCTAGAAATAGCAAGTTAAAATAAGGCTAGTCCGTTATCAACTTGAAAAAGTGGCACCGAGTCGGTGCtgcactggtttccgcctcCGACCTGTGGCTGGCCTGCTTtcc | 29816 | GTACTACTCCACTACCTAAAGTTTTAGAGCTAGAAATAGCAAGTTAAAATAAGGCTAGTCCGTTATCAACTTGAAAAAGTGGCACCGAGTCGGTGC | 30001 |
| 114 | SpyCas9-SpRY | - | TCCCAGCTTGCACTGGTTTCGTTTTAGAGCTAGAAATAGCAAGTTAAAATAAGGCTAGTCCGTTATCAACTTGAAAAAGTGGCACCGAGTCGGTGCaagcaggccagccacaggTCGGAGGCGGAAACCAGTGCaagc | 29817 | GGTATACATGGGCTTGGATCGTTTTAGAGCTAGAAATAGCAAGTTAAAATAAGGCTAGTCCGTTATCAACTTGAAAAAGTGGCACCGAGTCGGTGC | 30002 |
| 121 | ScaCas9-Sc++ | - | ATCCCAGCTTGCACTGGTTTGTTTTAGAGCTAGAAATAGCAAGTTAAAATAAGGCTAGTCCGTTATCAACTTGAAAAAGTGGCACCGAGTCGGTGCagcaggccagccacaggTCGGAGGCGGAAACCAGTGCAagct | 29818 | GTATACATGGGCTTGGATCCGTTTTAGAGCTAGAAATAGCAAGTTAAAATAAGGCTAGTCCGTTATCAACTTGAAAAAGTGGCACCGAGTCGGTGC | 30003 |
| 122 | SpyCas9-SpRY | - | ATCCCAGCTTGCACTGGTTTGTTTTAGAGCTAGAAATAGCAAGTTAAAATAAGGCTAGTCCGTTATCAACTTGAAAAAGTGGCACCGAGTCGGTGCagcaggccagccacaggTCGGAGGCGGAAACCAGTGCAagct | 29819 | GTATACATGGGCTTGGATCCGTTTTAGAGCTAGAAATAGCAAGTTAAAATAAGGCTAGTCCGTTATCAACTTGAAAAAGTGGCACCGAGTCGGTGC | 30004 |
| 123 | SpyCas9-SpRY | + | CCGAGAGGAAAGCAGGCCAGGTTTTAGAGCTAGAAATAGCAAGTTAAAATAAGGCTAGTCCGTTATCAACTTGAAAAAGTGGCACCGAGTCGGTGCgcactggtttccgcctcCGACCTGTGGCTGGCCTGCTTtcct | 29820 | TACTACTCCACTACCTAAAGGTTTTAGAGCTAGAAATAGCAAGTTAAAATAAGGCTAGTCCGTTATCAACTTGAAAAAGTGGCACCGAGTCGGTGC | 30005 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 124 | BlatCas9 | - | ttcaTCCCAGCTTGCACTGGTTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTagcaggccagccacaggTCGGAGGCGGAAACCAGTGCAagct | 29821 | ggggTATACATGGGCTTGGATCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30006 |
| 126 | Nme2Cas9 | - | ttTTCATCCCAGCTTGCACTGGTTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAgcaggccagccacaggTCGGAGGCGGAAACCAGTGCAAgctg | 29822 | cgGTTCGGGGGTATACATGGGCTTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 30007 |
| 127 | SpyCas9-SpRY | + | CCCGAGAGGAAAGCAGGCCAGTTTTAGAGCTAGAAATAGCAAGTTAAAATAAGGCTAGTCCGTTATCAACTTGAAAAAGTGGCACCGAGTCGGTGCcactggtttccgcctcCGACCTGTGGCTGGCCTGCTTTcctc | 29823 | ACTACTCCACTACCTAAAGGGTTTTAGAGCTAGAAATAGCAAGTTAAAATAAGGCTAGTCCGTTATCAACTTGAAAAAGTGGCACCGAGTCGGTGC | 30008 |
| 128 | SpyCas9-SpRY | - | CATCCCAGCTTGCACTGGTTGTTTTAGAGCTAGAAATAGCAAGTTAAAATAAGGCTAGTCCGTTATCAACTTGAAAAAGTGGCACCGAGTCGGTGCgcaggccagccacaggTCGGAGGCGGAAACCAGTGCAAgctg | 29824 | TATACATGGGCTTGGATCCAGTTTTAGAGCTAGAAATAGCAAGTTAAAATAAGGCTAGTCCGTTATCAACTTGAAAAAGTGGCACCGAGTCGGTGC | 30009 |
| 129 | BlatCas9 | + | aatcCCGAGAGGAAAGCAGGCCAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcactggtttccgcctcCGACCTGTGGCTGGCCTGCTTTcctc | 29825 | tgtaCTACTCCACTACCTAAAGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30010 |
| 130 | BlatCas9 | + | aatcCCGAGAGGAAAGCAGGCCAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcactggtttccgcctcCGACCTGTGGCTGGCCTGCTTTcctc | 29826 | tgtaCTACTCCACTACCTAAAGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30011 |
| 131 | BlatCas9 | - | tttcATCCCAGCTTGCACTGGTTGCTATAGTTCCTTACTGAAAGGTAAGTTGCTATAGTAAGGGCAACAGACCCGAGGCGTTGGGGATCGCCTAGCCCGTGTTTACGGGCT | 29827 | ggggTATACATGGGCTTGGATCCGCTATAGTTCCTTACTGAAAGGTAAGTTGCTATAGTAAGGGCAACAGACCCGAGGCGTTGGGGATCGCCTAGCCC | 30012 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | CTCCCCATATTCAAAATAATGACAGACGAGCACCTT GGAGCATTTATCTCCGAGGTGCTgcaggccagccacaggTCG GAGGCGGAAACCAGTGCAAgctg | | GTGTTTACGGGCTCTCCCCATATTCAAAATAAT GACAGACGAGCACCTTGGAGCATTTATCTCCG AGGTGCT | |
| 132 | SpyCas9-NG | + | TCCCGAGAGGAAAGCAGGCCGTTTTAGAGCTAGAAA TAGCAAGTTAAAATAAGGCTAGTCCGTTATCAACTT GAAAAAGTGGCACCGAGTCGGTGCactggtttccgcctcCGA CCTGTGGCTGGCCTGCTTTCctct | 29828 | GTACTACTCCACTACCTAAAGTTTTAGAGCTAG AAATAGCAAGTTAAAATAAGGCTAGTCCGTTA TCAACTTGAAAAAGTGGCACCGAGTCGGTGC | 30013 |
| 136 | SpyCas9-SpRY | + | TCCCGAGAGGAAAGCAGGCCGTTTTAGAGCTAGAAA TAGCAAGTTAAAATAAGGCTAGTCCGTTATCAACTT GAAAAAGTGGCACCGAGTCGGTGCactggtttccgcctcCGA CCTGTGGCTGGCCTGCTTTCctct | 29829 | CTACTCCACTACCTAAAGGTGTTTTAGAGCTAG AAATAGCAAGTTAAAATAAGGCTAGTCCGTTA TCAACTTGAAAAAGTGGCACCGAGTCGGTGC | 30014 |
| 137 | SpyCas9-SpRY | - | TCATCCCAGCTTGCACTGGTGTTTTAGAGCTAGAAAT AGCAAGTTAAAATAAGGCTAGTCCGTTATCAACTTG AAAAAGTGGCACCGAGTCGGTGCcaggccagccacaggTCG GAGGCGGAAACCAGTGCAAGctgg | 29830 | ATACATGGGCTTGGATCCATGTTTTAGAGCTA GAAATAGCAAGTTAAAATAAGGCTAGTCCGTT ATCAACTTGAAAAAGTGGCACCGAGTCGGTGC | 30015 |
| 141 | ScaCas9-Sc++ | + | ATCCCGAGAGGAAAGCAGGCGTTTTAGAGCTAGAAA TAGCAAGTTAAAATAAGGCTAGTCCGTTATCAACTT GAAAAAGTGGCACCGAGTCGGTGCctggtttccgcctcCGA CCTGTGGCTGGCCTGCTTTCCtctc | 29831 | TCCACTACCTAAAGGTCTCCGTTTTAGAGCTAG AAATAGCAAGTTAAAATAAGGCTAGTCCGTTA TCAACTTGAAAAAGTGGCACCGAGTCGGTGC | 30016 |
| 142 | SpyCas9-SpRY | + | ATCCCGAGAGGAAAGCAGGCGTTTTAGAGCTAGAAA TAGCAAGTTAAAATAAGGCTAGTCCGTTATCAACTT GAAAAAGTGGCACCGAGTCGGTGCctggtttccgcctcCGA CCTGTGGCTGGCCTGCTTTCCtctc | 29832 | TACTCCACTACCTAAAGGTCGTTTTAGAGCTAG AAATAGCAAGTTAAAATAAGGCTAGTCCGTTA TCAACTTGAAAAAGTGGCACCGAGTCGGTGC | 30017 |
| 143 | SpyCas9-SpRY | - | TTCATCCCAGCTTGCACTGGGTTTTAGAGCTAGAAAT AGCAAGTTAAAATAAGGCTAGTCCGTTATCAACTTG AAAAAGTGGCACCGAGTCGGTGCaggccagccacaggTCG GAGGCGGAAACCAGTGCAAGCtggg | 29833 | TACATGGGCTTGGATCCATGGTTTTAGAGCTA GAAATAGCAAGTTAAAATAAGGCTAGTCCGTT ATCAACTTGAAAAAGTGGCACCGAGTCGGTGC | 30018 |
| 144 | BlatCas9 | + | gaaaTCCCGAGAGGAAAGCAGGCGCTATAGTTCCTTA CTGAAAGGTAAGTTGCTATAGTAAGGGCAACAGACC CGAGGCGTTGGGGATCGCCTAGCCCGTGTTTACGGG CTCTCCCCATATTCAAAATAATGACAGACGAGCACC TTGGAGCATTTATCTCCGAGGTGCTctggtttccgcctcCGA CCTGTGGCTGGCCTGCTTTCCtctc | 29834 | tgtaCTACTCCACTACCTAAAGGGCTATAGTTCC TTACTGAAAGGTAAGTTGCTATAGTAAGGGCA ACAGACCCGAGGCGTTGGGGATCGCCTAGCCC GTGTTTACGGGCTCTCCCCATATTCAAAATAAT GACAGACGAGCACCTTGGAGCATTTATCTCCG AGGTGCT | 30019 |

TABLE 4C-continued

Exemplary template RNA sequences and second nick gRNA spacer sequences

Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 145 | BlatCas9 | - | ctttTCATCCCAGCTTGCACTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTaggccagccacaggTCGGAGGCGGAAACCAGTGCAAGCTggg | 29835 | ggggTATACATGGGCTTGGATCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30020 |
| 148 | Nme2Cas9 | + | aaGAAATCCCGAGAGGAAAGCAGGGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAtggtttccgcctcCGACCTGTGGCTGGCCTGCTTTCCTctcg | 29836 | taCTCCACTACCTAAAGGTCTCCTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 30021 |
| 149 | Nme2Cas9 | - | ttCTTTTCATCCCAGCTTGCACTGGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAggccagccacaggTCGGAGGCGGAAACCAGTGCAAGCTggga | 29837 | cgGTTCGGGGGTATACATGGGCTTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 30022 |
| 150 | SauriCas9-KKH | + | AAATCCCGAGAGGAAAGCAGGGTTTTAGTACTCTGGAAACAGAATCTACTAAAACAAGGCAAAATGCCGTGTTTATCTCGTCAACTTGTTGGCGAGAtggtttccgcctcCGACCTGTGGCTGGCCTGCTTTCCTctcg | 29838 | ACTCCACTACCTAAAGGTCTCGTTTTAGTACTCTGGAAACAGAATCTACTAAAACAAGGCAAAATGCCGTGTTTATCTCGTCAACTTGTTGGCGAGA | 30023 |
| 151 | SpyCas9-SpRY | + | AATCCCGAGAGGAAAGCAGGGTTTTAGAGCTAGAAATAGCAAGTTAAAATAAGGCTAGTCCGTTATCAACTTGAAAAAGTGGCACCGAGTCGGTGCtggtttccgcctcCGACCTGTGGCTGGCCTGCTTTCCTctcg | 29839 | ACTCCACTACCTAAAGGTCTGTTTTAGAGCTAGAAATAGCAAGTTAAAATAAGGCTAGTCCGTTATCAACTTGAAAAAGTGGCACCGAGTCGGTGC | 30024 |
| 152 | SpyCas9-SpRY | - | TTTCATCCCAGCTTGCACTGGTTTTAGAGCTAGAAATAGCAAGTTAAAATAAGGCTAGTCCGTTATCAACTTGAAAAAGTGGCACCGAGTCGGTGCggccagccacaggTCGGAGGCGGAAACCAGTGCAAGCTggga | 29840 | ACATGGGCTTGGATCCATGTGTTTTAGAGCTAGAAATAGCAAGTTAAAATAAGGCTAGTCCGTTATCAACTTGAAAAAGTGGCACCGAGTCGGTGC | 30025 |
| 153 | BlatCas9 | + | agaaATCCCGAGAGGAAAGCAGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTtggtttccgcctcCGACCTGTGGCTGGCCTGCTTTCCTctcg | 29841 | actcCACTACCTAAAGGTCTCCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30026 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 154 | BlatCas9 | - | tcttTTCATCCCAGCTTGCACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTggccagccacaggTCGGAGGCGGAAACCAGTGCAAGCTggga | 29842 | catgGGCTTGGATCCATGTCTGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30027 |
| 155 | SauCas9KKH | + | GAAATCCCGAGAGGAAAGCAGGTTTTAGTACTCTGGAAACAGAATCTACTAAAACAAGGCAAAATGCCGTGTTTATCTCGTCAACTTGTTGGCGAGAggtttccgcctcCGACCTGTGGCTGGCCTGCTTTCCTCtcgg | 29843 | TACTCCACTACCTAAAGGTCTGTTTTAGTACTCTGGAAACAGAATCTACTAAAACAAGGCAAAATGCCGTGTTTATCTCGTCAACTTGTTGGCGAGA | 30028 |
| 156 | SpyCas9-NG | - | TTTTCATCCCAGCTTGCACTGTTTTAGAGCTAGAAATAGCAAGTTAAAATAAGGCTAGTCCGTTATCAACTTGAAAAAGTGGCACCGAGTCGGTGCgccagccacaggTCGGAGGCGGAAACCAGTGCAAGCTGggat | 29844 | CATGGGCTTGGATCCATGTCGTTTTAGAGCTAGAAATAGCAAGTTAAAATAAGGCTAGTCCGTTATCAACTTGAAAAAGTGGCACCGAGTCGGTGC | 30029 |
| 160 | SpyCas9-SpRY | - | TTTTCATCCCAGCTTGCACTGTTTTAGAGCTAGAAATAGCAAGTTAAAATAAGGCTAGTCCGTTATCAACTTGAAAAAGTGGCACCGAGTCGGTGCgccagccacaggTCGGAGGCGGAAACCAGTGCAAGCTGggat | 29845 | CATGGGCTTGGATCCATGTCGTTTTAGAGCTAGAAATAGCAAGTTAAAATAAGGCTAGTCCGTTATCAACTTGAAAAAGTGGCACCGAGTCGGTGC | 30030 |
| 161 | SpyCas9-SpRY | + | AAATCCCGAGAGGAAAGCAGGTTTTAGAGCTAGAAATAGCAAGTTAAAATAAGGCTAGTCCGTTATCAACTTGAAAAAGTGGCACCGAGTCGGTGCggtttccgcctcCGACCTGTGGCTGGCCTGCTTTCCTCtcgg | 29846 | CTCCACTACCTAAAGGTCTCGTTTTAGAGCTAGAAATAGCAAGTTAAAATAAGGCTAGTCCGTTATCAACTTGAAAAAGTGGCACCGAGTCGGTGC | 30031 |
| 167 | ScaCas9-Sc++ | - | CTTTTCATCCCAGCTTGCACGTTTTAGAGCTAGAAATAGCAAGTTAAAATAAGGCTAGTCCGTTATCAACTTGAAAAAGTGGCACCGAGTCGGTGCccagccacaggTCGGAGGCGGAAACCAGTGCAAGCTGGgatg | 29847 | TGGGCTTGGATCCATGTCTGGTTTTAGAGCTAGAAATAGCAAGTTAAAATAAGGCTAGTCCGTTATCAACTTGAAAAAGTGGCACCGAGTCGGTGC | 30032 |
| 168 | SpyCas9 | - | CTTTTCATCCCAGCTTGCACGTTTTAGAGCTAGAAATAGCAAGTTAAAATAAGGCTAGTCCGTTATCAACTTGAAAAAGTGGCACCGAGTCGGTGCccagccacaggTCGGAGGCGGAAACCAGTGCAAGCTGGgatg | 29848 | TTCGGGGGTATACATGGGCTGTTTTAGAGCTAGAAATAGCAAGTTAAAATAAGGCTAGTCCGTTATCAACTTGAAAAAGTGGCACCGAGTCGGTGC | 30033 |
| 171 | SpyCas9-SpRY | - | CTTTTCATCCCAGCTTGCACGTTTTAGAGCTAGAAATAGCAAGTTAAAATAAGGCTAGTCCGTTATCAACTTGAAAAAGTGGCACCGAGTCGGTGCccagccacaggTCGGAGGCGGAAACCAGTGCAAGCTGGgatg | 29849 | ATGGGCTTGGATCCATGTCTGTTTTAGAGCTAGAAATAGCAAGTTAAAATAAGGCTAGTCCGTTATCAACTTGAAAAAGTGGCACCGAGTCGGTGC | 30034 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 172 | SpyCas9-NG | - | GAAATCCCGAGAGGAAAGCAGTTTTAGAGCTAGAAATAGCAAGTTAAAATAAGGCTAGTCCGTTATCAACTTGAAAAAGTGGCACCGAGTCGGTGCgtttccgcctcCGACCTGTGGCTGGCCTGCTTTCCTCTcggg | 29850 | CCACTACCTAAAGGTCTCCTGTTTTAGAGCTAGAAATAGCAAGTTAAAATAAGGCTAGTCCGTTATCAACTTGAAAAAGTGGCACCGAGTCGGTGC | 30035 |
| 175 | SpyCas9-NG | - | CTTTTCATCCCAGCTTGCACGTTTTAGAGCTAGAAATAGCAAGTTAAAATAAGGCTAGTCCGTTATCAACTTGAAAAAGTGGCACCGAGTCGGTGCccagccacaggTCGGAGGCGGAAACCAGTGCAAGCTGGgatg | 29851 | CATGGGCTTGGATCCATGTCGTTTTAGAGCTAGAAATAGCAAGTTAAAATAAGGCTAGTCCGTTATCAACTTGAAAAAGTGGCACCGAGTCGGTGC | 30036 |
| 179 | SpyCas9-SpRY | + | GAAATCCCGAGAGGAAAGCAGTTTTAGAGCTAGAAATAGCAAGTTAAAATAAGGCTAGTCCGTTATCAACTTGAAAAAGTGGCACCGAGTCGGTGCgtttccgcctcCGACCTGTGGCTGGCCTGCTTTCCTCTcggg | 29852 | TCCACTACCTAAAGGTCTCCGTTTTAGAGCTAGAAATAGCAAGTTAAAATAAGGCTAGTCCGTTATCAACTTGAAAAAGTGGCACCGAGTCGGTGC | 30037 |
| 183 | SauriCas9 | - | TTCTTTTCATCCCAGCTTGCAGTTTTAGTACTCTGGAAACAGAATCTACTAAAACAAGGCAAAATGCCGTGTTTATCTCGTCAACTTGTTGGCGAGAcagccacaggTCGGAGGCGGAAACCAGTGCAAGCTGGGatga | 29853 | ATGTCTGATGTACTGTGTGCAGTTTTAGTACTCTGGAAACAGAATCTACTAAAACAAGGCAAAATGCCGTGTTTATCTCGTCAACTTGTTGGCGAGA | 30038 |
| 184 | SauriCas9-KKH | - | TTCTTTTCATCCCAGCTTGCAGTTTTAGTACTCTGGAAACAGAATCTACTAAAACAAGGCAAAATGCCGTGTTTATCTCGTCAACTTGTTGGCGAGAcagccacaggTCGGAGGCGGAAACCAGTGCAAGCTGGGatga | 29854 | TCCATGTCTGATGTACTGTGTGTTTTAGTACTCTGGAAACAGAATCTACTAAAACAAGGCAAAATGCCGTGTTTATCTCGTCAACTTGTTGGCGAGA | 30039 |
| 187 | ScaCas9-Sc++ | + | AGAAATCCCGAGAGGAAAGCGTTTTAGAGCTAGAAATAGCAAGTTAAAATAAGGCTAGTCCGTTATCAACTTGAAAAAGTGGCACCGAGTCGGTGCtttccgcctcCGACCTGTGGCTGGCCTGCTTTCCTCTCggga | 29855 | CACTACCTAAAGGTCTCCTAGTTTTAGAGCTAGAAATAGCAAGTTAAAATAAGGCTAGTCCGTTATCAACTTGAAAAAGTGGCACCGAGTCGGTGC | 30040 |
| 188 | SpyCas9 | + | AGAAATCCCGAGAGGAAAGCGTTTTAGAGCTAGAAATAGCAAGTTAAAATAAGGCTAGTCCGTTATCAACTTGAAAAAGTGGCACCGAGTCGGTGCtttccgcctcCGACCTGTGGCTGGCCTGCTTTCCTCTCggga | 29856 | TGTACTACTCCACTACCTAAGTTTTAGAGCTAGAAATAGCAAGTTAAAATAAGGCTAGTCCGTTATCAACTTGAAAAAGTGGCACCGAGTCGGTGC | 30041 |
| 191 | SpyCas9-SpRY | + | AGAAATCCCGAGAGGAAAGCGTTTTAGAGCTAGAAATAGCAAGTTAAAATAAGGCTAGTCCGTTATCAACTTGAAAAAGTGGCACCGAGTCGGTGCtttccgcctcCGACCTGTGGCTGGCCTGCTTTCCTCTCggga | 29857 | CCACTACCTAAAGGTCTCCTGTTTTAGAGCTAGAAATAGCAAGTTAAAATAAGGCTAGTCCGTTATCAACTTGAAAAAGTGGCACCGAGTCGGTGC | 30042 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 194 | ScaCas9-Sc++ | - | TCTTTTCATCCCAGCTTGCAGTTTTAGAGCTAGAAATAGCAAGTTAAAATAAGGCTAGTCCGTTATCAACTTGAAAAAGTGGCACCGAGTCGGTGCcagccacaggTCGGAGGCGGAAACCAGTGCAAGCTGGGatga | 29858 | TGGGCTTGGATCCATGTCTGGTTTTAGAGCTAGAAATAGCAAGTTAAAATAAGGCTAGTCCGTTATCAACTTGAAAAAGTGGCACCGAGTCGGTGC | 30043 |
| 195 | SpyCas9-SpRY | - | TCTTTTCATCCCAGCTTGCAGTTTTAGAGCTAGAAATAGCAAGTTAAAATAAGGCTAGTCCGTTATCAACTTGAAAAAGTGGCACCGAGTCGGTGCcagccacaggTCGGAGGCGGAAACCAGTGCAAGCTGGGatga | 29859 | TGGGCTTGGATCCATGTCTGGTTTTAGAGCTAGAAATAGCAAGTTAAAATAAGGCTAGTCCGTTATCAACTTGAAAAAGTGGCACCGAGTCGGTGC | 30044 |
| 196 | SpyCas9-NG | + | AGAAATCCCGAGAGGAAAGCGTTTTAGAGCTAGAAATAGCAAGTTAAAATAAGGCTAGTCCGTTATCAACTTGAAAAAGTGGCACCGAGTCGGTGCtttccgcctcCGACCTGTGGCTGGCCTGCTTTCCTCTCggga | 29860 | CCACTACCTAAAGGTCTCCTGTTTTAGAGCTAGAAATAGCAAGTTAAAATAAGGCTAGTCCGTTATCAACTTGAAAAAGTGGCACCGAGTCGGTGC | 30045 |
| 199 | BlatCas9 | + | ccaaGAAATCCCGAGAGGAAAGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTtttccgcctcCGACCTGTGGCTGGCCTGCTTTCCTCTCggga | 29861 | actcCACTACCTAAAGGTCTCCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30046 |
| 203 | Nme2Cas9 | + | acCCAAGAAATCCCGAGAGGAAAGGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAttccgcctcCGACCTGTGGCTGGCCTGCTTTCCTCTCGggat | 29862 | taCTCCACTACCTAAAGGTCTCCTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 30047 |
| 204 | PpnCas9 | - | tttCTTCTTTTCATCCCAGCTTGCGTTGTAGCTCCCTTTTTCATTTCGCGAAAGCGAAATGAAAAACGTTGTTACAATAAGAGATGAATTTCTCGCAAAGCTCTGCCTCTTGAAATTTCGGTTTCAAGAGGCATCagccacaggTCGGAGGCGGAAACCAGTGCAAGCTGGGAtgaa | 29863 | aacTGGTAGCTGGAGGACAGTACTGTTGTAGCTCCCTTTTTCATTTCGCGAAAGCGAAATGAAAAACGTTGTTACAATAAGAGATGAATTTCTCGCAAAGCTCTGCCTCTTGAAATTTCGGTTTCAAGAGGCATC | 30048 |
| 205 | SauCas9KKH | - | CTTCTTTTCATCCCAGCTTGCGTTTTAGTACTCTGGAAACAGAATCTACTAAAACAAGGCAAAATGCCGTGTTTATCTCGTCAACTTGTTGGCGAGAagccacaggTCGGAGGCGGAAACCAGTGCAAGCTGGGAtgaa | 29864 | ATACATGGGCTTGGATCCATGGTTTTAGTACTCTGGAAACAGAATCTACTAAAACAAGGCAAAATGCCGTGTTTATCTCGTCAACTTGTTGGCGAGA | 30049 |
| 206 | SauCas9KKH | - | CTTCTTTTCATCCCAGCTTGCGTTTTAGTACTCTGGAAACAGAATCTACTAAAACAAGGCAAAATGCCGTGTT | 29865 | ATACATGGGCTTGGATCCATGGTTTTAGTACTCTGGAAACAGAATCTACTAAAACAAGGCAAAAT | 30050 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | TATCTCGTCAACTTGTTGGCGAGAagccacaggTCGGAG GCGGAAACCAGTGCAAGCTGGGAtgaa | | GCCGTGTTTATCTCGTCAACTTGTTGGCGAGA | |
| 207 | SauriCas9 | + | CAAGAAATCCCGAGAGGAAAGGTTTTAGTACTCTGG AAACAGAATCTACTAAAACAAGGCAAAATGCCGTGT TTATCTCGTCAACTTGTTGGCGAGAttccgcctcCGACCT GTGGCTGGCCTGCTTTCCTCTCGggat | 29866 | TGTGTACTACTCCACTACCTAGTTTTAGTACTC TGGAAACAGAATCTACTAAAACAAGGCAAAAT GCCGTGTTTATCTCGTCAACTTGTTGGCGAGA | 30051 |
| 208 | SauriCas9-KKH | + | CAAGAAATCCCGAGAGGAAAGGTTTTAGTACTCTGG AAACAGAATCTACTAAAACAAGGCAAAATGCCGTGT TTATCTCGTCAACTTGTTGGCGAGAttccgcctcCGACCT GTGGCTGGCCTGCTTTCCTCTCGggat | 29867 | ACTCCACTACCTAAAGGTCTCGTTTTAGTACTC TGGAAACAGAATCTACTAAAACAAGGCAAAAT GCCGTGTTTATCTCGTCAACTTGTTGGCGAGA | 30052 |
| 211 | ScaCas9-Sc++ | + | AAGAAATCCCGAGAGGAAAGGTTTTAGAGCTAGAA ATAGCAAGTTAAAATAAGGCTAGTCCGTTATCAACT TGAAAAAGTGGCACCGAGTCGGTGCttccgcctcCGACCT GTGGCTGGCCTGCTTTCCTCTCGggat | 29868 | CACTACCTAAAGGTCTCCTAGTTTTAGAGCTAG AAATAGCAAGTTAAAATAAGGCTAGTCCGTTA TCAACTTGAAAAAGTGGCACCGAGTCGGTGC | 30053 |
| 212 | SpyCas9-SpRY | + | AAGAAATCCCGAGAGGAAAGGTTTTAGAGCTAGAA ATAGCAAGTTAAAATAAGGCTAGTCCGTTATCAACT TGAAAAAGTGGCACCGAGTCGGTGCttccgcctcCGACCT GTGGCTGGCCTGCTTTCCTCTCGggat | 29869 | CACTACCTAAAGGTCTCCTAGTTTTAGAGCTAG AAATAGCAAGTTAAAATAAGGCTAGTCCGTTA TCAACTTGAAAAAGTGGCACCGAGTCGGTGC | 30054 |
| 213 | SpyCas9-SpRY | - | TTCTTTTCATCCCAGCTTGCGTTTTAGAGCTAGAAAT AGCAAGTTAAAATAAGGCTAGTCCGTTATCAACTTG AAAAAGTGGCACCGAGTCGGTGCagccacaggTCGGAG GCGGAAACCAGTGCAAGCTGGGAtgaa | 29870 | GGGCTTGGATCCATGTCTGAGTTTTAGAGCTA GAAATAGCAAGTTAAAATAAGGCTAGTCCGTT ATCAACTTGAAAAAGTGGCACCGAGTCGGTGC | 30055 |
| 214 | BlatCas9 | + | cccaAGAAATCCCGAGAGGAAAGGCTATAGTTCCTTA CTGAAAGGTAAGTTGCTATAGTAAGGGCAACAGACC CGAGGCGTTGGGGATCGCCTAGCCCGTGTTTACGGG CTCTCCCCATATTCAAAATAATGACAGACGAGCACC TTGGAGCATTTATCTCCGAGGTGCTttccgcctcCGACCT GTGGCTGGCCTGCTTTCCTCTCGggat | 29871 | ctccACTACCTAAAGGTCTCCTAGCTATAGTTCC TTACTGAAAGGTAAGTTGCTATAGTAAGGGCA ACAGACCCGAGGCGTTGGGGATCGCCTAGCCC GTGTTTACGGGCTCTCCCCATATTCAAAATAAT GACAGACGAGCACCTTGGAGCATTTATCTCCG AGGTGCT | 30056 |
| 215 | BlatCas9 | + | cccaAGAAATCCCGAGAGGAAAGGCTATAGTTCCTTA CTGAAAGGTAAGTTGCTATAGTAAGGGCAACAGACC CGAGGCGTTGGGGATCGCCTAGCCCGTGTTTACGGG CTCTCCCCATATTCAAAATAATGACAGACGAGCACC TTGGAGCATTTATCTCCGAGGTGCTttccgcctcCGACCT GTGGCTGGCCTGCTTTCCTCTCGggat | 29872 | ctccACTACCTAAAGGTCTCCTAGCTATAGTTCC TTACTGAAAGGTAAGTTGCTATAGTAAGGGCA ACAGACCCGAGGCGTTGGGGATCGCCTAGCCC GTGTTTACGGGCTCTCCCCATATTCAAAATAAT GACAGACGAGCACCTTGGAGCATTTATCTCCG AGGTGCT | 30057 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 217 | SauCas9KKH | + | CCAAGAAATCCCGAGAGGAAAGTTTTAGTACTCTGGAAACAGAATCTACTAAAACAAGGCAAAATGCCGTGTTTATCTCGTCAACTTGTTGGCGAGAtccgcctcCGACCTGTGGCTGGCCTGCTTTCCTCTCGGgatt | 29873 | ACCTAAAGGTCTCCTAGTGCCGTTTTAGTACTCTGGAAACAGAATCTACTAAAACAAGGCAAAATGCCGTGTTTATCTCGTCAACTTGTTGGCGAGA | 30058 |
| 218 | SauriCas9-KKH | + | CCAAGAAATCCCGAGAGGAAAGTTTTAGTACTCTGGAAACAGAATCTACTAAAACAAGGCAAAATGCCGTGTTTATCTCGTCAACTTGTTGGCGAGAtccgcctcCGACCTGTGGCTGGCCTGCTTTCCTCTCGGgatt | 29874 | ACTCCACTACCTAAAGGTCTCGTTTTAGTACTCTGGAAACAGAATCTACTAAAACAAGGCAAAATGCCGTGTTTATCTCGTCAACTTGTTGGCGAGA | 30059 |
| 219 | SpyCas9-SpRY | - | CTTCTTTTCATCCCAGCTTGGTTTTAGAGCTAGAAATAGCAAGTTAAAATAAGGCTAGTCCGTTATCAACTTGAAAAAGTGGCACCGAGTCGGTGCgccacaggTCGGAGGCGGAAACCAGTGCAAGCTGGGATgaaa | 29875 | GGCTTGGATCCATGTCTGATGTTTTAGAGCTAGAAATAGCAAGTTAAAATAAGGCTAGTCCGTTATCAACTTGAAAAAGTGGCACCGAGTCGGTGC | 30060 |
| 220 | SpyCas9-SpRY | + | CAAGAAATCCCGAGAGGAAAGTTTTAGAGCTAGAAATAGCAAGTTAAAATAAGGCTAGTCCGTTATCAACTTGAAAAAGTGGCACCGAGTCGGTGCtccgcctcCGACCTGTGGCTGGCCTGCTTTCCTCTCGGgatt | 29876 | ACTACCTAAAGGTCTCCTAGGTTTTAGAGCTAGAAATAGCAAGTTAAAATAAGGCTAGTCCGTTATCAACTTGAAAAAGTGGCACCGAGTCGGTGC | 30061 |
| 224 | SauCas9KKH | + | CCCAAGAAATCCCGAGAGGAAGTTTTAGTACTCTGGAAACAGAATCTACTAAAACAAGGCAAAATGCCGTGTTTATCTCGTCAACTTGTTGGCGAGAccgcctcCGACCTGTGGCTGGCCTGCTTTCCTCTCGGGattt | 29877 | ACCTAAAGGTCTCCTAGTGCCGTTTTAGTACTCTGGAAACAGAATCTACTAAAACAAGGCAAAATGCCGTGTTTATCTCGTCAACTTGTTGGCGAGA | 30062 |
| 225 | SpyCas9-NG | + | CCAAGAAATCCCGAGAGGAAGTTTTAGAGCTAGAAATAGCAAGTTAAAATAAGGCTAGTCCGTTATCAACTTGAAAAAGTGGCACCGAGTCGGTGCccgcctcCGACCTGTGGCTGGCCTGCTTTCCTCTCGGGattt | 29878 | ACTACCTAAAGGTCTCCTAGGTTTTAGAGCTAGAAATAGCAAGTTAAAATAAGGCTAGTCCGTTATCAACTTGAAAAAGTGGCACCGAGTCGGTGC | 30063 |
| 229 | SpyCas9-SpRY | + | CCAAGAAATCCCGAGAGGAAGTTTTAGAGCTAGAAATAGCAAGTTAAAATAAGGCTAGTCCGTTATCAACTTGAAAAAGTGGCACCGAGTCGGTGCccgcctcCGACCTGTGGCTGGCCTGCTTTCCTCTCGGGattt | 29879 | CTACCTAAAGGTCTCCTAGTGTTTTAGAGCTAGAAATAGCAAGTTAAAATAAGGCTAGTCCGTTATCAACTTGAAAAAGTGGCACCGAGTCGGTGC | 30064 |
| 230 | SpyCas9-SpRY | - | TCTTCTTTTCATCCCAGCTTGTTTTAGAGCTAGAAATAGCAAGTTAAAATAAGGCTAGTCCGTTATCAACTTGAAAAAGTGGCACCGAGTCGGTGCccacaggTCGGAGGCGGAAACCAGTGCAAGCTGGGATGaaaa | 29880 | GCTTGGATCCATGTCTGATGGTTTTAGAGCTAGAAATAGCAAGTTAAAATAAGGCTAGTCCGTTATCAACTTGAAAAAGTGGCACCGAGTCGGTGC | 30065 |

TABLE 4C-continued

Exemplary template RNA sequences and second nick gRNA spacer sequences

Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 236 | ScaCas9-Sc++ | + | CCCAAGAAATCCCGAGAGGAGTTTTAGAGCTAGAAATAGCAAGTTAAAATAAGGCTAGTCCGTTATCAACTTGAAAAAGTGGCACCGAGTCGGTGCcgcctcCGACCTGTGGCTGGCCTGCTTTCCTCTCGGGAtttc | 29881 | CACTACCTAAAGGTCTCCTAGTTTTAGAGCTAGAAATAGCAAGTTAAAATAAGGCTAGTCCGTTATCAACTTGAAAAAGTGGCACCGAGTCGGTGC | 30066 |
| 237 | SpyCas9-SpRY | + | CCCAAGAAATCCCGAGAGGAGTTTTAGAGCTAGAAATAGCAAGTTAAAATAAGGCTAGTCCGTTATCAACTTGAAAAAGTGGCACCGAGTCGGTGCcgcctcCGACCTGTGGCTGGCCTGCTTTCCTCTCGGGAtttc | 29882 | TACCTAAAGGTCTCCTAGTGGTTTTAGAGCTAGAAATAGCAAGTTAAAATAAGGCTAGTCCGTTATCAACTTGAAAAAGTGGCACCGAGTCGGTGC | 30067 |
| 238 | SpyCas9-NG | - | TTCTTCTTTTCATCCCAGCTGTTTTAGAGCTAGAAATAGCAAGTTAAAATAAGGCTAGTCCGTTATCAACTTGAAAAAGTGGCACCGAGTCGGTGCcacaggTCGGAGGCGGAAACCAGTGCAAGCTGGGATGAaaag | 29883 | TGGATCCATGTCTGATGTACGTTTTAGAGCTAGAAATAGCAAGTTAAAATAAGGCTAGTCCGTTATCAACTTGAAAAAGTGGCACCGAGTCGGTGC | 30068 |
| 242 | SpyCas9-SpRY | - | TTCTTCTTTTCATCCCAGCTGTTTTAGAGCTAGAAATAGCAAGTTAAAATAAGGCTAGTCCGTTATCAACTTGAAAAAGTGGCACCGAGTCGGTGCcacaggTCGGAGGCGGAAACCAGTGCAAGCTGGGATGAaaag | 29884 | CTTGGATCCATGTCTGATGTGTTTTAGAGCTAGAAATAGCAAGTTAAAATAAGGCTAGTCCGTTATCAACTTGAAAAAGTGGCACCGAGTCGGTGC | 30069 |
| 243 | BlatCas9 | - | tcttTCTTCTTTTCATCCCAGCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcacaggTCGGAGGCGGAAACCAGTGCAAGCTGGGATGAaaag | 29885 | catgGGCTTGGATCCATGTCTGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30070 |
| 244 | BlatCas9 | - | tcttTCTTCTTTTCATCCCAGCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcacaggTCGGAGGCGGAAACCAGTGCAAGCTGGGATGAaaag | 29886 | catgGGCTTGGATCCATGTCTGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30071 |
| 249 | SauriCas9-KKH | + | CACCCAAGAAATCCCGAGAGGGTTTTAGTACTCTGGAAACAGAATCTACTAAAACAAGGCAAAATGCCGTGTTTATCTCGTCAACTTGTTGGCGAGAgcctcCGACCTGTGGCTGGCCTGCTTTCCTCTCGGGATttct | 29887 | ACTCCACTACCTAAAGGTCTCGTTTTAGTACTCTGGAAACAGAATCTACTAAAACAAGGCAAAATGCCGTGTTTATCTCGTCAACTTGTTGGCGAGA | 30072 |
| 254 | ScaCas9-Sc++ | - | TTTCTTCTTTTCATCCCAGCGTTTTAGAGCTAGAAATAGCAAGTTAAAATAAGGCTAGTCCGTTATCAACTTG | 29888 | TTGGATCCATGTCTGATGTAGTTTTAGAGCTAGAAATAGCAAGTTAAAATAAGGCTAGTCCGTTA | 30073 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | AAAAAGTGGCACCGAGTCGGTGCacaggTCGGAGGCG GAAACCAGTGCAAGCTGGGATGAAaaga | | TCAACTTGAAAAAGTGGCACCGAGTCGGTGC | |
| 255 | SpyCas9-SpRY | - | TTTCTTCTTTTCATCCCAGCGTTTTAGAGCTAGAAAT AGCAAGTTAAAATAAGGCTAGTCCGTTATCAACTTG AAAAAGTGGCACCGAGTCGGTGCacaggTCGGAGGCG GAAACCAGTGCAAGCTGGGATGAAaaga | 29889 | TTGGATCCATGTCTGATGTAGTTTTAGAGCTAG AAATAGCAAGTTAAAATAAGGCTAGTCCGTTA TCAACTTGAAAAAGTGGCACCGAGTCGGTGC | 30074 |
| 256 | SpyCas9-SpRY | + | ACCCAAGAAATCCCGAGAGGGTTTTAGAGCTAGAAA TAGCAAGTTAAAATAAGGCTAGTCCGTTATCAACTT GAAAAAGTGGCACCGAGTCGGTGCgcctcCGACCTGTG GCTGGCCTGCTTTCCTCTCGGGATttct | 29890 | ACCTAAAGGTCTCCTAGTGCGTTTTAGAGCTA GAAATAGCAAGTTAAAATAAGGCTAGTCCGTT ATCAACTTGAAAAAGTGGCACCGAGTCGGTGC | 30075 |
| 257 | BlatCas9 | + | gccaCCCAAGAAATCCCGAGAGGGCTATAGTTCCTTA CTGAAAGGTAAGTTGCTATAGTAAGGGCAACAGACC CGAGGCGTTGGGGATCGCCTAGCCCGTGTTTACGGG CTCTCCCCATATTCAAAATAATGACAGACGAGCACC TTGGAGCATTTATCTCCGAGGTGCTgcctcCGACCTGTG GCTGGCCTGCTTTCCTCTCGGGATttct | 29891 | ccacTACCTAAAGGTCTCCTAGTGCTATAGTTCC TTACTGAAAGGTAAGTTGCTATAGTAAGGGCA ACAGACCCGAGGCGTTGGGGATCGCCTAGCCC GTGTTTACGGGCTCTCCCCATATTCAAAATAAT GACAGACGAGCACCTTGGAGCATTTATCTCCG AGGTGCT | 30076 |
| 258 | BlatCas9 | + | gccaCCCAAGAAATCCCGAGAGGGCTATAGTTCCTTA CTGAAAGGTAAGTTGCTATAGTAAGGGCAACAGACC CGAGGCGTTGGGGATCGCCTAGCCCGTGTTTACGGG CTCTCCCCATATTCAAAATAATGACAGACGAGCACC TTGGAGCATTTATCTCCGAGGTGCTgcctcCGACCTGTG GCTGGCCTGCTTTCCTCTCGGGATttct | 29892 | ccacTACCTAAAGGTCTCCTAGTGCTATAGTTCC TTACTGAAAGGTAAGTTGCTATAGTAAGGGCA ACAGACCCGAGGCGTTGGGGATCGCCTAGCCC GTGTTTACGGGCTCTCCCCATATTCAAAATAAT GACAGACGAGCACCTTGGAGCATTTATCTCCG AGGTGCT | 30077 |
| 260 | SauCas9KKH | + | CCACCCAAGAAATCCCGAGAGGTTTTAGTACTCTGG AAACAGAATCTACTAAAACAAGGCAAAATGCCGTGT TTATCTCGTCAACTTGTTGGCGAGAcctcCGACCTGTG GCTGGCCTGCTTTCCTCTCGGGATTtctt | 29893 | ACCTAAAGGTCTCCTAGTGCCGTTTTAGTACTC TGGAAACAGAATCTACTAAAACAAGGCAAAAT GCCGTGTTTATCTCGTCAACTTGTTGGCGAGA | 30078 |
| 261 | SpyCas9-SpRY | + | CACCCAAGAAATCCCGAGAGGTTTTAGAGCTAGAAA TAGCAAGTTAAAATAAGGCTAGTCCGTTATCAACTT GAAAAAGTGGCACCGAGTCGGTGCcctcCGACCTGTG GCTGGCCTGCTTTCCTCTCGGGATTtctt | 29894 | CCTAAAGGTCTCCTAGTGCCGTTTTAGAGCTAG AAATAGCAAGTTAAAATAAGGCTAGTCCGTTA TCAACTTGAAAAAGTGGCACCGAGTCGGTGC | 30079 |
| 263 | SpyCas9-SpRY | - | CTTTCTTCTTTTCATCCCAGGTTTTAGAGCTAGAAAT AGCAAGTTAAAATAAGGCTAGTCCGTTATCAACTTG AAAAAGTGGCACCGAGTCGGTGCcaggTCGGAGGCGG AAACCAGTGCAAGCTGGGATGAAAagaa | 29895 | TGGATCCATGTCTGATGTACGTTTTAGAGCTAG AAATAGCAAGTTAAAATAAGGCTAGTCCGTTA TCAACTTGAAAAAGTGGCACCGAGTCGGTGC | 30080 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 264 | BlatCas9 | - | tttcTTTCTTCTTTTCATCCCAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTcaggTCGGAGGCGGAAACCAGTGCAAGCTGGGATGAAAagaa | 29896 | ttggATCCATGTCTGATGTACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30081 |
| 269 | SauCas9KKH | + | GCCACCCAAGAAATCCCGAGAGTTTTAGTACTCTGGAAACAGAATCTACTAAAACAAGGCAAAATGCCGTGTTTATCTCGTCAACTTGTTGGCGAGActcCGACCTGTGGCTGGCCTGCTTTCCTCTCGGGATTTcttg | 29897 | ACCTAAAGGTCTCCTAGTGCCGTTTTAGTACTCTGGAAACAGAATCTACTAAAACAAGGCAAAATGCCGTGTTTATCTCGTCAACTTGTTGGCGAGA | 30082 |
| 270 | SpyCas9-NG | + | CCACCCAAGAAATCCCGAGAGTTTTAGAGCTAGAAATAGCAAGTTAAAATAAGGCTAGTCCGTTATCAACTTGAAAAAGTGGCACCGAGTCGGTGCctcCGACCTGTGGCTGGCCTGCTTTCCTCTCGGGATTTcttg | 29898 | TAAAGGTCTCCTAGTGCCTCGTTTTAGAGCTAGAAATAGCAAGTTAAAATAAGGCTAGTCCGTTATCAACTTGAAAAAGTGGCACCGAGTCGGTGC | 30083 |
| 274 | SpyCas9-SpRY | + | CCACCCAAGAAATCCCGAGAGTTTTAGAGCTAGAAATAGCAAGTTAAAATAAGGCTAGTCCGTTATCAACTTGAAAAAGTGGCACCGAGTCGGTGCctcCGACCTGTGGCTGGCCTGCTTTCCTCTCGGGATTTcttg | 29899 | CTAAAGGTCTCCTAGTGCCTGTTTTAGAGCTAGAAATAGCAAGTTAAAATAAGGCTAGTCCGTTATCAACTTGAAAAAGTGGCACCGAGTCGGTGC | 30084 |
| 275 | SpyCas9-SpRY | - | TCTTTCTTCTTTTCATCCCAGTTTTAGAGCTAGAAATAGCAAGTTAAAATAAGGCTAGTCCGTTATCAACTTGAAAAAGTGGCACCGAGTCGGTGCaggTCGGAGGCGGAAACCAGTGCAAGCTGGGATGAAAAgaag | 29900 | GGATCCATGTCTGATGTACTGTTTTAGAGCTAGAAATAGCAAGTTAAAATAAGGCTAGTCCGTTATCAACTTGAAAAAGTGGCACCGAGTCGGTGC | 30085 |
| 281 | SauCas9 | + | caGGCCACCCAAGAAATCCCGAGGTTTTAGTACTCTGGAAACAGAATCTACTAAAACAAGGCAAAATGCCGTGTTTATCTCGTCAACTTGTTGGCGAGAtcCGACCTGTGGCTGGCCTGCTTTCCTCTCGGGATTTCttgg | 29901 | ctAGTGCCTCTGACTCAGTGGTGGTTTTAGTACTCTGGAAACAGAATCTACTAAAACAAGGCAAAATGCCGTGTTTATCTCGTCAACTTGTTGGCGAGA | 30086 |
| 282 | SauCas9KKH | + | GGCCACCCAAGAAATCCCGAGGTTTTAGTACTCTGGAAACAGAATCTACTAAAACAAGGCAAAATGCCGTGTTTATCTCGTCAACTTGTTGGCGAGAtcCGACCTGTGGCTGGCCTGCTTTCCTCTCGGGATTTCttgg | 29902 | ACCTAAAGGTCTCCTAGTGCCGTTTTAGTACTCTGGAAACAGAATCTACTAAAACAAGGCAAAATGCCGTGTTTATCTCGTCAACTTGTTGGCGAGA | 30087 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 285 | ScaCas9-Sc++ | + | GCCACCCAAGAAATCCCGAGGTTTTAGAGCTAGAAATAGCAAGTTAAAATAAGGCTAGTCCGTTATCAACTTGAAAAAGTGGCACCGAGTCGGTGCtcCGACCTGTGGCTGGCCTGCTTTCCTCTCGGGATTTCttgg | 29903 | CTAAAGGTCTCCTAGTGCCTGTTTTAGAGCTAGAAATAGCAAGTTAAAATAAGGCTAGTCCGTTATCAACTTGAAAAAGTGGCACCGAGTCGGTGC | 30088 |
| 286 | SpyCas9 | + | GCCACCCAAGAAATCCCGAGGTTTTAGAGCTAGAAATAGCAAGTTAAAATAAGGCTAGTCCGTTATCAACTTGAAAAAGTGGCACCGAGTCGGTGCtcCGACCTGTGGCTGGCCTGCTTTCCTCTCGGGATTTCttgg | 29904 | TCCTAGTGCCTCTGACTCAGGTTTTAGAGCTAGAAATAGCAAGTTAAAATAAGGCTAGTCCGTTATCAACTTGAAAAAGTGGCACCGAGTCGGTGC | 30089 |
| 289 | SpyCas9-SpRY | + | GCCACCCAAGAAATCCCGAGGTTTTAGAGCTAGAAATAGCAAGTTAAAATAAGGCTAGTCCGTTATCAACTTGAAAAAGTGGCACCGAGTCGGTGCtcCGACCTGTGGCTGGCCTGCTTTCCTCTCGGGATTTCttgg | 29905 | TAAAGGTCTCCTAGTGCCTCGTTTTAGAGCTAGAAATAGCAAGTTAAAATAAGGCTAGTCCGTTATCAACTTGAAAAAGTGGCACCGAGTCGGTGC | 30090 |
| 290 | SpyCas9-NG | + | GCCACCCAAGAAATCCCGAGGTTTTAGAGCTAGAAATAGCAAGTTAAAATAAGGCTAGTCCGTTATCAACTTGAAAAAGTGGCACCGAGTCGGTGCtcCGACCTGTGGCTGGCCTGCTTTCCTCTCGGGATTTCttgg | 29906 | TAAAGGTCTCCTAGTGCCTCGTTTTAGAGCTAGAAATAGCAAGTTAAAATAAGGCTAGTCCGTTATCAACTTGAAAAAGTGGCACCGAGTCGGTGC | 30091 |
| 293 | SpyCas9-NG | - | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGCggTCGGAGGCGGAAACCAGTGCAAGCTGGGATGAAAAGaaga | 29907 | GATCCATGTCTGATGTACTGGTTTTAGAGCTAGAAATAGCAAGTTAAAATAAGGCTAGTCCGTTATCAACTTGAAAAAGTGGCACCGAGTCGGTGC | 30092 |
| 297 | SpyCas9-SpRY | - | TTCTTTCTTCTTTTCATCCCGTTTTAGAGCTAGAAATAGCAAGTTAAAATAAGGCTAGTCCGTTATCAACTTGAAAAAGTGGCACCGAGTCGGTGCggTCGGAGGCGGAAACCAGTGCAAGCTGGGATGAAAAGaaga | 29908 | GATCCATGTCTGATGTACTGGTTTTAGAGCTAGAAATAGCAAGTTAAAATAAGGCTAGTCCGTTATCAACTTGAAAAAGTGGCACCGAGTCGGTGC | 30093 |
| 303 | SauCas9 | + | ccAGGCCACCCAAGAAATCCCGAGTTTTAGTACTCTGGAAACAGAATCTACTAAAACAAGGCAAAATGCCGTGTTTATCTCGTCAACTTGTTGGCGAGAcCGACCTGTGGCTGGCCTGCTTTCCTCTCGGGATTTCTtggg | 29909 | ctAGTGCCTCTGACTCAGTGGTGGTTTTAGTACTCTGGAAACAGAATCTACTAAAACAAGGCAAAATGCCGTGTTTATCTCGTCAACTTGTTGGCGAGA | 30094 |
| 304 | SauCaS9KKH | + | AGGCCACCCAAGAAATCCCGAGTTTTAGTACTCTGGAAACAGAATCTACTAAAACAAGGCAAAATGCCGTGTTTATCTCGTCAACTTGTTGGCGAGAcCGACCTGTGGCTGGCCTGCTTTCCTCTCGGGATTTCTtggg | 29910 | AAGGTCTCCTAGTGCCTCTGAGTTTTAGTACTCTGGAAACAGAATCTACTAAAACAAGGCAAAATGCCGTGTTTATCTCGTCAACTTGTTGGCGAGA | 30095 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 305 | SauriCas9 | + | AGGCCACCCAAGAAATCCCGAGTTTTAGTACTCTGG AAACAGAATCTACTAAAACAAGGCAAAATGCCGTGT TTATCTCGTCAACTTGTTGGCGAGAcCGACCTGTGGC TGGCCTGCTTTCCTCTCGGGATTTCTtggg | 29911 | TCTCCTAGTGCCTCTGACTCAGTTTTAGTACTC TGGAAACAGAATCTACTAAAACAAGGCAAAAT GCCGTGTTTATCTCGTCAACTTGTTGGCGAGA | 30096 |
| 306 | SauriCas9-KKH | + | AGGCCACCCAAGAAATCCCGAGTTTTAGTACTCTGG AAACAGAATCTACTAAAACAAGGCAAAATGCCGTGT TTATCTCGTCAACTTGTTGGCGAGAcCGACCTGTGGC TGGCCTGCTTTCCTCTCGGGATTTCTtggg | 29912 | AGGTCTCCTAGTGCCTCTGACGTTTTAGTACTC TGGAAACAGAATCTACTAAAACAAGGCAAAAT GCCGTGTTTATCTCGTCAACTTGTTGGCGAGA | 30097 |
| 309 | ScaCas9-Sc++ | + | GGCCACCCAAGAAATCCCGAGTTTTAGAGCTAGAAA TAGCAAGTTAAAATAAGGCTAGTCCGTTATCAACTT GAAAAAGTGGCACCGAGTCGGTGCcCGACCTGTGGC TGGCCTGCTTTCCTCTCGGGATTTCTtggg | 29913 | CTAAAGGTCTCCTAGTGCCTGTTTTAGAGCTAG AAATAGCAAGTTAAAATAAGGCTAGTCCGTTA TCAACTTGAAAAAGTGGCACCGAGTCGGTGC | 30098 |
| 310 | SpyCas9-SpRY | + | GGCCACCCAAGAAATCCCGAGTTTTAGAGCTAGAAA TAGCAAGTTAAAATAAGGCTAGTCCGTTATCAACTT GAAAAAGTGGCACCGAGTCGGTGCcCGACCTGTGGC TGGCCTGCTTTCCTCTCGGGATTTCTtggg | 29914 | AAAGGTCTCCTAGTGCCTCTGTTTTAGAGCTAG AAATAGCAAGTTAAAATAAGGCTAGTCCGTTA TCAACTTGAAAAAGTGGCACCGAGTCGGTGC | 30099 |
| 313 | ScaCas9-Sc++ | - | TTTCTTTCTTCTTTTCATCCGTTTTAGAGCTAGAAATA GCAAGTTAAAATAAGGCTAGTCCGTTATCAACTTGA AAAAGTGGCACCGAGTCGGTGCgTCGGAGGCGGAAA CCAGTGCAAGCTGGGATGAAAAGAagaa | 29915 | ATCCATGTCTGATGTACTGTGTTTTAGAGCTAG AAATAGCAAGTTAAAATAAGGCTAGTCCGTTA TCAACTTGAAAAAGTGGCACCGAGTCGGTGC | 30100 |
| 314 | SpyCas9-SpRY | - | TTTCTTTCTTCTTTTCATCCGTTTTAGAGCTAGAAATA GCAAGTTAAAATAAGGCTAGTCCGTTATCAACTTGA AAAAGTGGCACCGAGTCGGTGCgTCGGAGGCGGAAA CCAGTGCAAGCTGGGATGAAAAGAagaa | 29916 | ATCCATGTCTGATGTACTGTGTTTTAGAGCTAG AAATAGCAAGTTAAAATAAGGCTAGTCCGTTA TCAACTTGAAAAAGTGGCACCGAGTCGGTGC | 30101 |
| 315 | St1Cas9 | + | GGCCACCCAAGAAATCCCGAGTCTTTGTACTCTGGT ACCAGAAGCTACAAAGATAAGGCTTCATGCCGAAAT CAACACCCTGTCATTTTATGGCAGGGTGTTTTcCGAC CTGTGGCTGGCCTGCTTTCCTCTCGGGATTTCTtggg | 29917 | NAGTCTTTGTACTCTGGTACCAGAAGCTACAA AGATAAGGCTTCATGCCGAAATCAACACCCTG TCATTTTATGGCAGGGTGTTTT | 30102 |
| 319 | SauCas9KKH | + | CAGGCCACCCAAGAAATCCCGGTTTTAGTACTCTGG AAACAGAATCTACTAAAACAAGGCAAAATGCCGTGT TTATCTCGTCAACTTGTTGGCGAGACGACCTGTGGCT GGCCTGCTTTCCTCTCGGGATTTCTTgggt | 29918 | AAGGTCTCCTAGTGCCTCTGAGTTTTAGTACTC TGGAAACAGAATCTACTAAAACAAGGCAAAAT GCCGTGTTTATCTCGTCAACTTGTTGGCGAGA | 30103 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 320 | SauriCas9-KKH | + | CAGGCCACCCAAGAAATCCCGGTTTTAGTACTCTGGAAACAGAATCTACTAAAACAAGGCAAAATGCCGTGTTTATCTCGTCAACTTGTTGGCGAGACGACCTGTGGCTGGCCTGCTTTCCTCTCGGGATTTCTTgggt | 29919 | AGGTCTCCTAGTGCCTCTGACGTTTTAGTACTCTGGAAACAGAATCTACTAAAACAAGGCAAAATGCCGTGTTTATCTCGTCAACTTGTTGGCGAGA | 30104 |
| 322 | SauriCas9-KKH | - | GTTTTCTTTCTTCTTTTCATCGTTTTAGTACTCTGGAAACAGAATCTACTAAAACAAGGCAAAATGCCGTGTTTATCTCGTCAACTTGTTGGCGAGATCGGAGGCGGAAACCAGTGCAAGCTGGGATGAAAAGAAgaaa | 29920 | TCCATGTCTGATGTACTGTGTGTTTTAGTACTCTGGAAACAGAATCTACTAAAACAAGGCAAAATGCCGTGTTTATCTCGTCAACTTGTTGGCGAGA | 30105 |
| 323 | SpyCas9-NG | + | AGGCCACCCAAGAAATCCCGGTTTTAGAGCTAGAAATAGCAAGTTAAAATAAGGCTAGTCCGTTATCAACTTGAAAAAGTGGCACCGAGTCGGTGCCGACCTGTGGCTGGCCTGCTTTCCTCTCGGGATTTCTTgggt | 29921 | TAAAGGTCTCCTAGTGCCTCGTTTTAGAGCTAGAAATAGCAAGTTAAAATAAGGCTAGTCCGTTATCAACTTGAAAAAGTGGCACCGAGTCGGTGC | 30106 |
| 327 | SpyCas9-SpRY | + | AGGCCACCCAAGAAATCCCGGTTTTAGAGCTAGAAATAGCAAGTTAAAATAAGGCTAGTCCGTTATCAACTTGAAAAAGTGGCACCGAGTCGGTGCCGACCTGTGGCTGGCCTGCTTTCCTCTCGGGATTTCTTgggt | 29922 | AAGGTCTCCTAGTGCCTCTGGTTTTAGAGCTAGAAATAGCAAGTTAAAATAAGGCTAGTCCGTTATCAACTTGAAAAAGTGGCACCGAGTCGGTGC | 30107 |
| 328 | SpyCas9-SpRY | - | TTTTCTTTCTTCTTTTCATCGTTTTAGAGCTAGAAATAGCAAGTTAAAATAAGGCTAGTCCGTTATCAACTTGAAAAAGTGGCACCGAGTCGGTGCTCGGAGGCGGAAACCAGTGCAAGCTGGGATGAAAAGAAgaaa | 29923 | TCCATGTCTGATGTACTGTGGTTTTAGAGCTAGAAATAGCAAGTTAAAATAAGGCTAGTCCGTTATCAACTTGAAAAAGTGGCACCGAGTCGGTGC | 30108 |
| 329 | St1Cas9 | + | AGGCCACCCAAGAAATCCCGGTCTTTGTACTCTGGTACCAGAAGCTACAAAGATAAGGCTTCATGCCGAAATCAACACCCTGTCATTTTATGGCAGGGTGTTTTCGACCTGTGGCTGGCCTGCTTTCCTCTCGGGATTTCTTgggt | 29924 | NAGTCTTTGTACTCTGGTACCAGAAGCTACAAAGATAAGGCTTCATGCCGAAATCAACACCCTGTCATTTTATGGCAGGGTGTTTT | 30109 |
| 330 | BlatCas9 | - | gagtTTTCTTTCTTCTTTTCATCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTCGGAGGCGGAAACCAGTGCAAGCTGGGATGAAAAGAAgaaa | 29925 | ttggATCCATGTCTGATGTACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30110 |
| 331 | BlatCas9 | - | gagtTTTCTTTCTTCTTTTCATCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTG | 29926 | ttggATCCATGTCTGATGTACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATG | 30111 |

TABLE 4C-continued

Exemplary template RNA sequences and second nick gRNA spacer sequences
Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | GAGCATTTATCTCCGAGGTGCTTCGGAGGCGGAAACCAGTGCAAGCTGGGATGAAAAGAAgaaa | | ACAGACGAGCACCTTGGAGCATTTATCTCCGAGGTGCT | |
| 336 | SauCas9 | + | ggCCAGGCCACCCAAGAAATCCCGTTTTAGTACTCTGGAAACAGAATCTACTAAAACAAGGCAAAATGCCGTGTTTATCTCGTCAACTTGTTGGCGAGAGACCTGTGGCTGGCCTGCTTTCCTCTCGGGATTTCTTGggtg | 29927 | ctAGTGCCTCTGACTCAGTGGTGGTTTTAGTACTCTGGAAACAGAATCTACTAAAACAAGGCAAAATGCCGTGTTTATCTCGTCAACTTGTTGGCGAGA | 30112 |
| 337 | SauCas9KKH | + | CCAGGCCACCCAAGAAATCCCGTTTTAGTACTCTGGAAACAGAATCTACTAAAACAAGGCAAAATGCCGTGTTTATCTCGTCAACTTGTTGGCGAGAGACCTGTGGCTGGCCTGCTTTCCTCTCGGGATTTCTTGggtg | 29928 | AAGGTCTCCTAGTGCCTCTGAGTTTTAGTACTCTGGAAACAGAATCTACTAAAACAAGGCAAAATGCCGTGTTTATCTCGTCAACTTGTTGGCGAGA | 30113 |
| 338 | SauCas9KKH | - | AGTTTTCTTTCTTCTTTTCATGTTTTAGTACTCTGGAAACAGAATCTACTAAAACAAGGCAAAATGCCGTGTTTATCTCGTCAACTTGTTGGCGAGACGGAGGCGGAAACCAGTGCAAGCTGGGATGAAAAGAAGaaag | 29929 | ATCCATGTCTGATGTACTGTGGTTTTAGTACTCTGGAAACAGAATCTACTAAAACAAGGCAAAATGCCGTGTTTATCTCGTCAACTTGTTGGCGAGA | 30114 |
| 341 | ScaCas9-Sc++ | + | CAGGCCACCCAAGAAATCCCGTTTTAGAGCTAGAAATAGCAAGTTAAAATAAGGCTAGTCCGTTATCAACTTGAAAAAGTGGCACCGAGTCGGTGCGACCTGTGGCTGGCCTGCTTTCCTCTCGGGATTTCTTGggtg | 29930 | GTCTCCTAGTGCCTCTGACTGTTTTAGAGCTAGAAATAGCAAGTTAAAATAAGGCTAGTCCGTTATCAACTTGAAAAAGTGGCACCGAGTCGGTGC | 30115 |
| 342 | SpyCas9-SpRY | - | CAGGCCACCCAAGAAATCCCGTTTTAGAGCTAGAAATAGCAAGTTAAAATAAGGCTAGTCCGTTATCAACTTGAAAAAGTGGCACCGAGTCGGTGCGACCTGTGGCTGGCCTGCTTTCCTCTCGGGATTTCTTGggtg | 29931 | AGGTCTCCTAGTGCCTCTGAGTTTTAGAGCTAGAAATAGCAAGTTAAAATAAGGCTAGTCCGTTATCAACTTGAAAAAGTGGCACCGAGTCGGTGC | 30116 |
| 343 | SpyCas9-SpRY | - | GTTTTCTTTCTTCTTTTCATGTTTTAGAGCTAGAAATAGCAAGTTAAAATAAGGCTAGTCCGTTATCAACTTGAAAAAGTGGCACCGAGTCGGTGCCGGAGGCGGAAACCAGTGCAAGCTGGGATGAAAAGAAGaaag | 29932 | CCATGTCTGATGTACTGTGTGTTTTAGAGCTAGAAATAGCAAGTTAAAATAAGGCTAGTCCGTTATCAACTTGAAAAAGTGGCACCGAGTCGGTGC | 30117 |
| 350 | SauCas9KKH | + | GCCAGGCCACCCAAGAAATCCGTTTTAGTACTCTGGAAACAGAATCTACTAAAACAAGGCAAAATGCCGTGTTTATCTCGTCAACTTGTTGGCGAGAACCTGTGGCTGGCCTGCTTTCCTCTCGGGATTTCTTGGgtgg | 29933 | AAGGTCTCCTAGTGCCTCTGAGTTTTAGTACTCTGGAAACAGAATCTACTAAAACAAGGCAAAATGCCGTGTTTATCTCGTCAACTTGTTGGCGAGA | 30118 |

TABLE 4C-continued

Exemplary template RNA sequences and second nick gRNA spacer sequences

Table 4C provides design of RNA components of gene modifying systems for correcting the pathogenic R243Q, mutation in PAH. The gRNA spacers from Table 1C were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 351 | SauriCas9-KKH | + | GCCAGGCCACCCAAGAAATCCGTTTTAGTACTCTGGAAACAGAATCTACTAAAACAAGGCAAAATGCCGTGTTTATCTCGTCAACTTGTTGGCGAGAACCTGTGGCTGGCCTGCTTTCCTCTCGGGATTTCTTGGgtgg | 29934 | AGGTCTCCTAGTGCCTCTGACGTTTTAGTACTCTGGAAACAGAATCTACTAAAACAAGGCAAAATGCCGTGTTTATCTCGTCAACTTGTTGGCGAGA | 30119 |
| 353 | SpyCas9-NG | + | CCAGGCCACCCAAGAAATCCGTTTTAGAGCTAGAAATAGCAAGTTAAAATAAGGCTAGTCCGTTATCAACTTGAAAAAGTGGCACCGAGTCGGTGCACCTGTGGCTGGCCTGCTTTCCTCTCGGGATTTCTTGGgtgg | 29935 | TCTCCTAGTGCCTCTGACTCGTTTTAGAGCTAGAAATAGCAAGTTAAAATAAGGCTAGTCCGTTATCAACTTGAAAAAGTGGCACCGAGTCGGTGC | 30120 |
| 357 | SpyCas9-SpRY | + | CCAGGCCACCCAAGAAATCCGTTTTAGAGCTAGAAATAGCAAGTTAAAATAAGGCTAGTCCGTTATCAACTTGAAAAAGTGGCACCGAGTCGGTGCACCTGTGGCTGGCCTGCTTTCCTCTCGGGATTTCTTGGgtgg | 29936 | GGTCTCCTAGTGCCTCTGACGTTTTAGAGCTAGAAATAGCAAGTTAAAATAAGGCTAGTCCGTTATCAACTTGAAAAAGTGGCACCGAGTCGGTGC | 30121 |
| 358 | SpyCas9-SpRY | - | AGTTTTCTTTCTTCTTTTCAGTTTTAGAGCTAGAAATAGCAAGTTAAAATAAGGCTAGTCCGTTATCAACTTGAAAAAGTGGCACCGAGTCGGTGCGGAGGCGGAAACCAGTGCAAGCTGGGATGAAAAGAAGAaaga | 29937 | CATGTCTGATGTACTGTGTGGTTTTAGAGCTAGAAATAGCAAGTTAAAATAAGGCTAGTCCGTTATCAACTTGAAAAAGTGGCACCGAGTCGGTGC | 30122 |

TABLE 4D

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 1 | SpyCas9-SpRY | - | ATAATAACTTTTCACTTAGGGTTTTAGAGCTAGAAATAGCAAGTTAAAATAAGGCTAGTCCGTTATCAACTTGAAAAAGTGGCACCGAGTCGGTGCgcttctctgataagcagtactgtaggccCCAAGTGAAAAgtt | 30123 | TCTCTGCCACGTAATAGAGGGTTTTAGAGCTAGAAATAGCAAGTTAAAATAAGGCTAGTCCGTTATCAACTTGAAAAAGTGGCACCGAGTCGGTGC | 30272 |
| 2 | SauCas9KKH | + | TAAGCAGTACTGTAGGCCCTAGTTTTAGTACTCTGGAAACAGAATCTACTAAAACAAGGCAAAATGCCGTGTTTATCTCGTCAACTTGTTGGCGAGAatttaacagtgataataacttttcactTGGGGCCTACAgtac | 30124 | GCATTTGGGCTGTGATGTAGAGTTTTAGTACTCTGGAAACAGAATCTACTAAAACAAGGCAAAATGCCGTGTTTATCTCGTCAACTTGTTGGCGAGA | 30273 |
| 3 | SpyCas9-NG | - | GATAATAACTTTTCACTTAGGTTTTAGAGCTAGAAATAGCAAGTTAAAATAAGGCTAGTCCGTTATCAACTTGAAAAAGTGGCACCGAGTCGGTGCcttctctgataagcagtactgtaggcccCAAGTGAAAAgtta | 30125 | TCTCTGCCACGTAATAGAGGGTTTTAGAGCTAGAAATAGCAAGTTAAAATAAGGCTAGTCCGTTATCAACTTGAAAAAGTGGCACCGAGTCGGTGC | 30274 |
| 6 | SpyCas9-NG | + | AAGCAGTACTGTAGGCCCTAGTTTTAGAGCTAGAAATAGCAAGTTAAAATAAGGCTAGTCCGTTATCAACTTGAAAAAGTGGCACCGAGTCGGTGCatttaacagtgataataacttttcactTGGGGCCTACAgtac | 30126 | ATTTGGGCTGTGATGTAGAAGTTTTAGAGCTAGAAATAGCAAGTTAAAATAAGGCTAGTCCGTTATCAACTTGAAAAAGTGGCACCGAGTCGGTGC | 30275 |
| 10 | SpyCas9-SpRY | - | GATAATAACTTTTCACTTAGGTTTTAGAGCTAGAAATAGCAAGTTAAAATAAGGCTAGTCCGTTATCAACTTGAAAAAGTGGCACCGAGTCGGTGCcttctctgataagcagtactgtaggcccCAAGTGAAAAgtta | 30127 | CTCTGCCACGTAATAGAGGGGTTTTAGAGCTAGAAATAGCAAGTTAAAATAAGGCTAGTCCGTTATCAACTTGAAAAAGTGGCACCGAGTCGGTGC | 30276 |
| 12 | SpyCas9-SpRY | + | AAGCAGTACTGTAGGCCCTAGTTTTAGAGCTAGAAATAGCAAGTTAAAATAAGGCTAGTCCGTTATCAACTTGAAAAAGTGGCACCGAGTCGGTGCatttaacagtgataataacttttcactTGGGGCCTACAgtac | 30128 | TTTGGGCTGTGATGTAGAAGGTTTTAGAGCTAGAAATAGCAAGTTAAAATAAGGCTAGTCCGTTATCAACTTGAAAAAGTGGCACCGAGTCGGTGC | 30277 |
| 16 | ScaCas9-Sc++ | - | TGATAATAACTTTTCACTTAGTTTTAGAGCTAGAAATAGCAAGTTAAAATAAGGCTAGTCCGTTATCAACTTGAAAAAGTGGCACCGAGTCGGTGCttctctgataagcagtactgtaggccCCAAGTGAAAAGttat | 30129 | TCTGCCACGTAATAGAGGGGGTTTTAGAGCTAGAAATAGCAAGTTAAAATAAGGCTAGTCCGTTATCAACTTGAAAAAGTGGCACCGAGTCGGTGC | 30278 |
| 17 | SpyCas9 | - | TGATAATAACTTTTCACTTAGTTTTAGAGCTAGAAATAGCAAGTTAAAATAAGGCTAGTCCGTTATCAACTTGAAAAAGTGGCACCGAGTCGGTGCttctctgataagcagtactgtaggccCCAAGTGAAAAGttat | 30130 | CTGCCACGTAATAGAGGGGCGTTTTAGAGCTAGAAATAGCAAGTTAAAATAAGGCTAGTCCGTTATCAACTTGAAAAAGTGGCACCGAGTCGGTGC | 30279 |

TABLE 4D-continued

Exemplary template RNA sequences and second nick gRNA spacer sequences

Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 20 | SpyCas9-SpRY | - | TGATAATAACTTTTCACTTAGTTTTAGAGCTAGAAATAGCAAGTTAAAATAAGGCTAGTCCGTTATCAACTTGAAAAAGTGGCACCGAGTCGGTGCttctctgataagcagtactgtaggcccCCAAGTGAAAAGttat | 30131 | TCTGCCACGTAATAGAGGGGGTTTTAGAGCTAGAAATAGCAAGTTAAAATAAGGCTAGTCCGTTATCAACTTGAAAAAGTGGCACCGAGTCGGTGC | 30280 |
| 23 | ScaCas9-Sc++ | + | TAAGCAGTACTGTAGGCCCTGTTTTAGAGCTAGAAATAGCAAGTTAAAATAAGGCTAGTCCGTTATCAACTTGAAAAAGTGGCACCGAGTCGGTGCtttaacagtgataataacttttcactTGGGGCCTACAGtact | 30132 | GGGCTGTGATGTAGAAGGAAGTTTTAGAGCTAGAAATAGCAAGTTAAAATAAGGCTAGTCCGTTATCAACTTGAAAAAGTGGCACCGAGTCGGTGC | 30281 |
| 24 | SpyCas9-SpRY | + | TAAGCAGTACTGTAGGCCCTGTTTTAGAGCTAGAAATAGCAAGTTAAAATAAGGCTAGTCCGTTATCAACTTGAAAAAGTGGCACCGAGTCGGTGCtttaacagtgataataacttttcactTGGGGCCTACAGtact | 30133 | TTGGGCTGTGATGTAGAAGGGTTTTAGAGCTAGAAATAGCAAGTTAAAATAAGGCTAGTCCGTTATCAACTTGAAAAAGTGGCACCGAGTCGGTGC | 30282 |
| 25 | SpyCas9-NG | - | TGATAATAACTTTTCACTTAGTTTTAGAGCTAGAAATAGCAAGTTAAAATAAGGCTAGTCCGTTATCAACTTGAAAAAGTGGCACCGAGTCGGTGCttctctgataagcagtactgtaggcccCCAAGTGAAAAGttat | 30134 | CTGCCACGTAATAGAGGGGCGTTTTAGAGCTAGAAATAGCAAGTTAAAATAAGGCTAGTCCGTTATCAACTTGAAAAAGTGGCACCGAGTCGGTGC | 30283 |
| 28 | BlatCas9 | - | cagtGATAATAACTTTTCACTTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTttctctgataagcagtactgtaggcccCCAAGTGAAAAGttat | 30135 | ctctGCCACGTAATAGAGGGGCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30284 |
| 31 | Nme2Cas9 | - | aaCAGTGATAATAACTTTTCACTTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAtctctgataagcagtactgtaggcccCCAAGTGAAAAGTtatt | 30136 | tcTGCCACGTAATAGAGGGGCTGGGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 30285 |
| 32 | SauriCas9 | - | AGTGATAATAACTTTTCACTTGTTTTAGTACTCTGGAAACAGAATCTACTAAAACAAGGCAAAATGCCGTGTTTATCTCGTCAACTTGTTGGCGAGAtctctgataagcagtactgtaggcccCCAAGTGAAAAGTtatt | 30137 | CTCTGCCACGTAATAGAGGGGGTTTTAGTACTCTGGAAACAGAATCTACTAAAACAAGGCAAAATGCCGTGTTTATCTCGTCAACTTGTTGGCGAGA | 30286 |
| 33 | SauriCas9-KKH | - | AGTGATAATAACTTTTCACTTGTTTTAGTACTCTGGAAACAGAATCTACTAAAACAAGGCAAAATGCCGTGTTTAT | 30138 | CTCTGCCACGTAATAGAGGGGGTTTTAGTACTCTGGAAACAGAATCTACTAAAACAAGGCAAA | 30287 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | CTCGTCAACTTGTTGGCGAGAtctctgataagcagtactgtaggcccCC AAGTGAAAAGTtatt | | ATGCCGTGTTTATCTCGTCAACTTGTTGGCGA GA | |
| 34 | SauriCas9-KKH | + | GATAAGCAGTACTGTAGGCCCGTTTTAGTACTCTGGAA ACAGAATCTACTAAAACAAGGCAAAATGCCGTGTTTAT CTCGTCAACTTGTTGGCGAGAttaacagtgataataacttttcactTGG GGCCTACAGTactg | 30139 | TGGGCTGTGATGTAGAAGGAAGTTTTAGTACT CTGGAAACAGAATCTACTAAAACAAGGCAAA ATGCCGTGTTTATCTCGTCAACTTGTTGGCGA GA | 30288 |
| 39 | ScaCas9-Sc++ | - | GTGATAATAACTTTTCACTTGTTTTAGAGCTAGAAATA GCAAGTTAAAATAAGGCTAGTCCGTTATCAACTTGAAA AAGTGGCACCGAGTCGGTGCtctctgataagcagtactgtaggcccCC AAGTGAAAAGTtatt | 30140 | CTGCCACGTAATAGAGGGGCGTTTTAGAGCTA GAAATAGCAAGTTAAAATAAGGCTAGTCCGT TATCAACTTGAAAAAGTGGCACCGAGTCGGT GC | 30289 |
| 40 | SpyCas9 | - | GTGATAATAACTTTTCACTTGTTTTAGAGCTAGAAATA GCAAGTTAAAATAAGGCTAGTCCGTTATCAACTTGAAA AAGTGGCACCGAGTCGGTGCtctctgataagcagtactgtaggcccCC AAGTGAAAAGTtatt | 30141 | CTGCCACGTAATAGAGGGGCGTTTTAGAGCTA GAAATAGCAAGTTAAAATAAGGCTAGTCCGT TATCAACTTGAAAAAGTGGCACCGAGTCGGT GC | 30290 |
| 43 | SpyCas9-SpRY | - | GTGATAATAACTTTTCACTTGTTTTAGAGCTAGAAATA GCAAGTTAAAATAAGGCTAGTCCGTTATCAACTTGAAA AAGTGGCACCGAGTCGGTGCtctctgataagcagtactgtaggcccCC AAGTGAAAAGTtatt | 30142 | CTGCCACGTAATAGAGGGGCGTTTTAGAGCTA GAAATAGCAAGTTAAAATAAGGCTAGTCCGT TATCAACTTGAAAAAGTGGCACCGAGTCGGT GC | 30291 |
| 44 | SpyCas9-NG | - | GTGATAATAACTTTTCACTTGTTTTAGAGCTAGAAATA GCAAGTTAAAATAAGGCTAGTCCGTTATCAACTTGAAA AAGTGGCACCGAGTCGGTGCtctctgataagcagtactgtaggcccCC AAGTGAAAAGTtatt | 30143 | CTGCCACGTAATAGAGGGGCGTTTTAGAGCTA GAAATAGCAAGTTAAAATAAGGCTAGTCCGT TATCAACTTGAAAAAGTGGCACCGAGTCGGT GC | 30292 |
| 47 | SpyCas9-SpRY | + | ATAAGCAGTACTGTAGGCCCGTTTTAGAGCTAGAAATA GCAAGTTAAAATAAGGCTAGTCCGTTATCAACTTGAAA AAGTGGCACCGAGTCGGTGCttaacagtgataataacttttcactTGG GGCCTACAGTactg | 30144 | TGGGCTGTGATGTAGAAGGAGTTTTAGAGCTA GAAATAGCAAGTTAAAATAAGGCTAGTCCGT TATCAACTTGAAAAAGTGGCACCGAGTCGGT GC | 30293 |
| 48 | BlatCas9 | - | acagTGATAATAACTTTTCACTTGCTATAGTTCCTTACTG AAAGGTAAGTTGCTATAGTAAGGGCAACAGACCCGAG GCGTTGGGGATCGCCTAGCCCGTGTTTACGGGCTCTCC CCATATTCAAAATAATGACAGACGAGCACCTTGGAGC ATTTATCTCCGAGGTGCTtctctgataagcagtactgtaggcccCCAAG TGAAAAGTtatt | 30145 | ctctGCCACGTAATAGAGGGGCTGCTATAGTTC CTTACTGAAAGGTAAGTTGCTATAGTAAGGGC AACAGACCCGAGGCGTTGGGGATCGCCTAGC CCGTGTTTACGGGCTCTCCCCATATTCAAAAT AATGACAGACGAGCACCTTGGAGCATTTATCT CCGAGGTGCT | 30294 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 49 | BlatCas9 | - | acagTGATAATAACTTTTCACTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTctctgataagcagtactgtaggccCCAAGTGAAAAGTtatt | 30146 | ctctGCCACGTAATAGAGGGGCTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30295 |
| 52 | SauCas9 | - | aaCAGTGATAATAACTTTTCACTGTTTTAGTACTCTGGAAACAGAATCTACTAAAACAAGGCAAAATGCCGTGTTTATCTCGTCAACTTGTTGGCGAGActctgataagcagtactgtaggccCCAAGTGAAAAGTTatta | 30147 | tcTCTGCCACGTAATAGAGGGGCGTTTTAGTACTCTGGAAACAGAATCTACTAAAACAAGGCAAAATGCCGTGTTTATCTCGTCAACTTGTTGGCGAGA | 30296 |
| 53 | SauCas9KKH | - | CAGTGATAATAACTTTTCACTGTTTTAGTACTCTGGAAACAGAATCTACTAAAACAAGGCAAAATGCCGTGTTTATCTCGTCAACTTGTTGGCGAGActctgataagcagtactgtaggccCCAAGTGAAAAGTTatta | 30148 | TCTGCCACGTAATAGAGGGGCGTTTTAGTACTCTGGAAACAGAATCTACTAAAACAAGGCAAAATGCCGTGTTTATCTCGTCAACTTGTTGGCGAGA | 30297 |
| 54 | SauCas9KKH | + | TGATAAGCAGTACTGTAGGCCGTTTTAGTACTCTGGAAACAGAATCTACTAAAACAAGGCAAAATGCCGTGTTTATCTCGTCAACTTGTTGGCGAGAtaacagtgataataacttttcactTGGGGCCTACAGTActgc | 30149 | TGGGCTGTGATGTAGAAGGAAGTTTTAGTACTCTGGAAACAGAATCTACTAAAACAAGGCAAAATGCCGTGTTTATCTCGTCAACTTGTTGGCGAGA | 30298 |
| 55 | SauCas9KKH | + | TGATAAGCAGTACTGTAGGCCGTTTTAGTACTCTGGAAACAGAATCTACTAAAACAAGGCAAAATGCCGTGTTTATCTCGTCAACTTGTTGGCGAGAtaacagtgataataacttttcactTGGGGCCTACAGTActgc | 30150 | TGGGCTGTGATGTAGAAGGAAGTTTTAGTACTCTGGAAACAGAATCTACTAAAACAAGGCAAAATGCCGTGTTTATCTCGTCAACTTGTTGGCGAGA | 30299 |
| 58 | SauriCas9 | - | CAGTGATAATAACTTTTCACTGTTTTAGTACTCTGGAAACAGAATCTACTAAAACAAGGCAAAATGCCGTGTTTATCTCGTCAACTTGTTGGCGAGActctgataagcagtactgtaggccCCAAGTGAAAAGTTatta | 30151 | CTCTGCCACGTAATAGAGGGGGTTTTAGTACTCTGGAAACAGAATCTACTAAAACAAGGCAAAATGCCGTGTTTATCTCGTCAACTTGTTGGCGAGA | 30300 |
| 59 | SauriCas9-KKH | - | CAGTGATAATAACTTTTCACTGTTTTAGTACTCTGGAAACAGAATCTACTAAAACAAGGCAAAATGCCGTGTTTATCTCGTCAACTTGTTGGCGAGActctgataagcagtactgtaggccCCAAGTGAAAAGTTatta | 30152 | CTCTGCCACGTAATAGAGGGGGTTTTAGTACTCTGGAAACAGAATCTACTAAAACAAGGCAAAATGCCGTGTTTATCTCGTCAACTTGTTGGCGAGA | 30301 |
| 62 | ScaCas9-Sc++ | - | AGTGATAATAACTTTTCACTGTTTTAGAGCTAGAAATAGCAAGTTAAAATAAGGCTAGTCCGTTATCAACTTGAAAAAGTGGCACCGAGTCGGTGCctctgataagcagtactgtaggccCCAAGTGAAAAGTTatta | 30153 | CTGCCACGTAATAGAGGGGCGTTTTAGAGCTAGAAATAGCAAGTTAAAATAAGGCTAGTCCGTTATCAACTTGAAAAAGTGGCACCGAGTCGGTGC | 30302 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 63 | SpyCas9-SpRY | - | AGTGATAATAACTTTTCACTGTTTTAGAGCTAGAAATAGCAAGTTAAAATAAGGCTAGTCCGTTATCAACTTGAAAAAGTGGCACCGAGTCGGTGCctctgataagcagtactgtaggcccCCAAGTGAAAAGTTatta | 30154 | TGCCACGTAATAGAGGGGCTGTTTTAGAGCTAGAAATAGCAAGTTAAAATAAGGCTAGTCCGTTATCAACTTGAAAAAGTGGCACCGAGTCGGTGC | 30303 |
| 64 | SpyCas9-SpRY | + | GATAAGCAGTACTGTAGGCCGTTTTAGAGCTAGAAATAGCAAGTTAAAATAAGGCTAGTCCGTTATCAACTTGAAAAAGTGGCACCGAGTCGGTGCtaacagtgataataacttttcactTGGGGCCTACAGTACtgc | 30155 | GGGCTGTGATGTAGAAGGAAGTTTTAGAGCTAGAAATAGCAAGTTAAAATAAGGCTAGTCCGTTATCAACTTGAAAAAGTGGCACCGAGTCGGTGC | 30304 |
| 67 | SauCas9KKH | + | CTGATAAGCAGTACTGTAGGCGTTTTAGTACTCTGGAAACAGAATCTACTAAAACAAGGCAAAATGCCGTGTTTATCTCGTCAACTTGTTGGCGAGAaacagtgataataacttttcactTGGGGCCTACAGTACtgct | 30156 | GGGCTGTGATGTAGAAGGAATGTTTTAGTACTCTGGAAACAGAATCTACTAAAACAAGGCAAAATGCCGTGTTTATCTCGTCAACTTGTTGGCGAGA | 30305 |
| 68 | SauCas9KKH | - | ACAGTGATAATAACTTTTCACGTTTTAGTACTCTGGAAACAGAATCTACTAAAACAAGGCAAAATGCCGTGTTTATCTCGTCAACTTGTTGGCGAGAtctgataagcagtactgtaggcccCCAAGTGAAAAGTTAttat | 30157 | TCTGCCACGTAATAGAGGGGCGTTTTAGTACTCTGGAAACAGAATCTACTAAAACAAGGCAAAATGCCGTGTTTATCTCGTCAACTTGTTGGCGAGA | 30306 |
| 69 | SauriCas9-KKH | - | ACAGTGATAATAACTTTTCACGTTTTAGTACTCTGGAAACAGAATCTACTAAAACAAGGCAAAATGCCGTGTTTATCTCGTCAACTTGTTGGCGAGAtctgataagcagtactgtaggcccCCAAGTGAAAAGTTAttat | 30158 | CTCTGCCACGTAATAGAGGGGGTTTTAGTACTCTGGAAACAGAATCTACTAAAACAAGGCAAAATGCCGTGTTTATCTCGTCAACTTGTTGGCGAGA | 30307 |
| 70 | SpyCas9-SpRY | + | TGATAAGCAGTACTGTAGGCGTTTTAGAGCTAGAAATAGCAAGTTAAAATAAGGCTAGTCCGTTATCAACTTGAAAAAGTGGCACCGAGTCGGTGCaacagtgataataacttttcactTGGGGCCTACAGTACtgct | 30159 | GGCTGTGATGTAGAAGGAATGTTTTAGAGCTAGAAATAGCAAGTTAAAATAAGGCTAGTCCGTTATCAACTTGAAAAAGTGGCACCGAGTCGGTGC | 30308 |
| 71 | SpyCas9-SpRY | - | CAGTGATAATAACTTTTCACGTTTTAGAGCTAGAAATAGCAAGTTAAAATAAGGCTAGTCCGTTATCAACTTGAAAAAGTGGCACCGAGTCGGTGCtctgataagcagtactgtaggcccCCAAGTGAAAAGTTAttat | 30160 | GCCACGTAATAGAGGGGCTGGTTTTAGAGCTAGAAATAGCAAGTTAAAATAAGGCTAGTCCGTTATCAACTTGAAAAAGTGGCACCGAGTCGGTGC | 30309 |
| 74 | SauCas9KKH | - | AACAGTGATAATAACTTTTCAGTTTTAGTACTCTGGAAACAGAATCTACTAAAACAAGGCAAAATGCCGTGTTTATCTCGTCAACTTGTTGGCGAGActgataagcagtactgtaggcccCCAAGTGAAAAGTTATtatc | 30161 | TCTGCCACGTAATAGAGGGGCGTTTTAGTACTCTGGAAACAGAATCTACTAAAACAAGGCAAAATGCCGTGTTTATCTCGTCAACTTGTTGGCGAGA | 30310 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 75 | SpyCas9-SpRY | + | CTGATAAGCAGTACTGTAGGGTTTTAGAGCTAGAAATAGCAAGTTAAAATAAGGCTAGTCCGTTATCAACTTGAAAAAGTGGCACCGAGTCGGTGCacagtgataataacttttcactTGGGGCCTACAGTACTGctt | 30162 | GCTGTGATGTAGAAGGAATCGTTTTAGAGCTAGAAATAGCAAGTTAAAATAAGGCTAGTCCGTTATCAACTTGAAAAAGTGGCACCGAGTCGGTGC | 30311 |
| 76 | SpyCas9-SpRY | - | ACAGTGATAATAACTTTTCAGTTTTAGAGCTAGAAATAGCAAGTTAAAATAAGGCTAGTCCGTTATCAACTTGAAAAAGTGGCACCGAGTCGGTGCctgataagcagtactgtaggccCCAAGTGAAAAGTTATtatc | 30163 | CCACGTAATAGAGGGGCTGGGTTTTAGAGCTAGAAATAGCAAGTTAAAATAAGGCTAGTCCGTTATCAACTTGAAAAAGTGGCACCGAGTCGGTGC | 30312 |
| 77 | SpyCas9-SpRY | + | TCTGATAAGCAGTACTGTAGGTTTTAGAGCTAGAAATAGCAAGTTAAAATAAGGCTAGTCCGTTATCAACTTGAAAAAGTGGCACCGAGTCGGTGCcagtgataataacttttcactTGGGGCCTACAGTACTGctta | 30164 | CTGTGATGTAGAAGGAATCGGTTTTAGAGCTAGAAATAGCAAGTTAAAATAAGGCTAGTCCGTTATCAACTTGAAAAAGTGGCACCGAGTCGGTGC | 30313 |
| 78 | SpyCas9-SpRY | - | AACAGTGATAATAACTTTTCGTTTTAGAGCTAGAAATAGCAAGTTAAAATAAGGCTAGTCCGTTATCAACTTGAAAAAGTGGCACCGAGTCGGTGCtgataagcagtactgtaggccCCAAGTGAAAAGTTATTatca | 30165 | CACGTAATAGAGGGGCTGGAGTTTTAGAGCTAGAAATAGCAAGTTAAAATAAGGCTAGTCCGTTATCAACTTGAAAAAGTGGCACCGAGTCGGTGC | 30314 |
| 79 | SpyCas9-NG | + | CTCTGATAAGCAGTACTGTAGTTTTAGAGCTAGAAATAGCAAGTTAAAATAAGGCTAGTCCGTTATCAACTTGAAAAAGTGGCACCGAGTCGGTGCagtgataataacttttcactTGGGGCCTACAGTACTGCttat | 30166 | TGTGATGTAGAAGGAATCGGGTTTTAGAGCTAGAAATAGCAAGTTAAAATAAGGCTAGTCCGTTATCAACTTGAAAAAGTGGCACCGAGTCGGTGC | 30315 |
| 83 | SpyCas9-SpRY | - | CTCTGATAAGCAGTACTGTAGTTTTAGAGCTAGAAATAGCAAGTTAAAATAAGGCTAGTCCGTTATCAACTTGAAAAAGTGGCACCGAGTCGGTGCagtgataataacttttcactTGGGGCCTACAGTACTGCttat | 30167 | TGTGATGTAGAAGGAATCGGGTTTTAGAGCTAGAAATAGCAAGTTAAAATAAGGCTAGTCCGTTATCAACTTGAAAAAGTGGCACCGAGTCGGTGC | 30316 |
| 84 | SpyCas9-SpRY | - | TAACAGTGATAATAACTTTTGTTTTAGAGCTAGAAATAGCAAGTTAAAATAAGGCTAGTCCGTTATCAACTTGAAAAAGTGGCACCGAGTCGGTGCgataagcagtactgtaggccCCAAGTGAAAAGTTATTAtcac | 30168 | ACGTAATAGAGGGGCTGGAAGTTTTAGAGCTAGAAATAGCAAGTTAAAATAAGGCTAGTCCGTTATCAACTTGAAAAAGTGGCACCGAGTCGGTGC | 30317 |
| 85 | BlatCas9 | + | cttcTCTGATAAGCAGTACTGTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTAgtgataataacttttcactTGGGGCCTACAGTACTGCttat | 30169 | gcatTTGGGCTGTGATGTAGAAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30318 |

TABLE 4D-continued

Exemplary template RNA sequences and second nick gRNA spacer sequences

Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 86 | BlatCas9 | + | cttcTCTGATAAGCAGTACTGTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTAgtgataataacttttcactTGGGGCCTACAGTACTGCttat | 30170 | gcatTTGGGCTGTGATGTAGAAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30319 |
| 87 | BlatCas9 | + | cttcTCTGATAAGCAGTACTGTAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTAgtgataataacttttcactTGGGGCCTACAGTACTGCttat | 30171 | gcatTTGGGCTGTGATGTAGAAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30320 |
| 90 | Nme2Cas9 | − | ggCTTCTCTGATAAGCAGTACTGTGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAgtgataataacttttcactTGGGGCCTACAGTACTGCTtatc | 30172 | ggTGAGATGAGAGAAGGGGCACAAGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 30321 |
| 93 | ScaCas9-Sc++ | + | TCTCTGATAAGCAGTACTGTGTTTTAGAGCTAGAAATAGCAAGTTAAAATAAGGCTAGTCCGTTATCAACTTGAAAAAGTGGCACCGAGTCGGTGCgtgataataacttttcactTGGGGCCTACAGTACTGCTtatc | 30173 | GTGATGTAGAAGGAATCGGGGTTTTAGAGCTAGAAATAGCAAGTTAAAATAAGGCTAGTCCGTTATCAACTTGAAAAAGTGGCACCGAGTCGGTGC | 30322 |
| 94 | SpyCas9 | + | TCTCTGATAAGCAGTACTGTGTTTTAGAGCTAGAAATAGCAAGTTAAAATAAGGCTAGTCCGTTATCAACTTGAAAAAGTGGCACCGAGTCGGTGCgtgataataacttttcactTGGGGCCTACAGTACTGCTtatc | 30174 | CTGTGATGTAGAAGGAATCGGTTTTAGAGCTAGAAATAGCAAGTTAAAATAAGGCTAGTCCGTTATCAACTTGAAAAAGTGGCACCGAGTCGGTGC | 30323 |
| 97 | SpyCas9-SpRY | + | TCTCTGATAAGCAGTACTGTGTTTTAGAGCTAGAAATAGCAAGTTAAAATAAGGCTAGTCCGTTATCAACTTGAAAAAGTGGCACCGAGTCGGTGCgtgataataacttttcactTGGGGCCTACAGTACTGCTtatc | 30175 | GTGATGTAGAAGGAATCGGGGTTTTAGAGCTAGAAATAGCAAGTTAAAATAAGGCTAGTCCGTTATCAACTTGAAAAAGTGGCACCGAGTCGGTGC | 30324 |
| 98 | SpyCas9-NG | + | TCTCTGATAAGCAGTACTGTGTTTTAGAGCTAGAAATAGCAAGTTAAAATAAGGCTAGTCCGTTATCAACTTGAAAAAGTGGCACCGAGTCGGTGCgtgataataacttttcactTGGGGCCTACAGTACTGCTtatc | 30176 | TGTGATGTAGAAGGAATCGGGTTTTAGAGCTAGAAATAGCAAGTTAAAATAAGGCTAGTCCGTTATCAACTTGAAAAAGTGGCACCGAGTCGGTGC | 30325 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 101 | SpyCas9-SpRY | - | TTAACAGTGATAATAACTTTGTTTTAGAGCTAGAAATAGCAAGTTAAAATAAGGCTAGTCCGTTATCAACTTGAAAAAGTGGCACCGAGTCGGTGCataagcagtactgtaggccCCAAGTGAAAAGTTATTATcact | 30177 | CGTAATAGAGGGGCTGGAACGTTTTAGAGCTAGAAATAGCAAGTTAAAATAAGGCTAGTCCGTTATCAACTTGAAAAAGTGGCACCGAGTCGGTGC | 30326 |
| 102 | BlatCas9 | + | gcttCTCTGATAAGCAGTACTGTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTgtgataataacttttcactTGGGGCCTACAGTACTGCTtatc | 30178 | gcatTTGGGCTGTGATGTAGAAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30327 |
| 103 | BlatCas9 | + | gcttCTCTGATAAGCAGTACTGTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTgtgataataacttttcactTGGGGCCTACAGTACTGCTtatc | 30179 | gcatTTGGGCTGTGATGTAGAAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30328 |
| 106 | Nme2Cas9 | + | tgGCTTCTCTGATAAGCAGTACTGGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTAtgataataacttttcactTGGGGCCTACAGTACTGCTTatca | 30180 | ggTGAGATGAGAGAAGGGGCACAAGTTGTAGCTCCCTTTCTCATTTCGGAAACGAAATGAGAACCGTTGCTACAATAAGGCCGTCTGAAAAGATGTGCCGCAACGCTCTGCCCCTTAAAGCTTCTGCTTTAAGGGGCATCGTTTA | 30329 |
| 107 | SauriCas9 | + | CTTCTCTGATAAGCAGTACTGGTTTTAGTACTCTGGAAACAGAATCTACTAAAACAAGGCAAAATGCCGTGTTTATCTCGTCAACTTGTTGGCGAGAtgataataacttttcactTGGGGCCTACAGTACTGCTTatca | 30181 | GGCTGTGATGTAGAAGGAATCGTTTTAGTACTCTGGAAACAGAATCTACTAAAACAAGGCAAAATGCCGTGTTTATCTCGTCAACTTGTTGGCGAGA | 30330 |
| 108 | SauriCas9-KKH | + | CTTCTCTGATAAGCAGTACTGGTTTTAGTACTCTGGAAACAGAATCTACTAAAACAAGGCAAAATGCCGTGTTTATCTCGTCAACTTGTTGGCGAGAtgataataacttttcactTGGGGCCTACAGTACTGCTTatca | 30182 | GTGATGTAGAAGGAATCGGGGGTTTTAGTACTCTGGAAACAGAATCTACTAAAACAAGGCAAAATGCCGTGTTTATCTCGTCAACTTGTTGGCGAGA | 30331 |
| 111 | ScaCas9-Sc++ | + | TTCTCTGATAAGCAGTACTGGTTTTAGAGCTAGAAATAGCAAGTTAAAATAAGGCTAGTCCGTTATCAACTTGAAAAAGTGGCACCGAGTCGGTGCtgataataacttttcactTGGGGCCTACAGTACTGCTTatca | 30183 | GTGATGTAGAAGGAATCGGGGTTTTAGAGCTAGAAATAGCAAGTTAAAATAAGGCTAGTCCGTTATCAACTTGAAAAAGTGGCACCGAGTCGGTGC | 30332 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 112 | SpyCas9-SpRY | + | TTCTCTGATAAGCAGTACTGGTTTTAGAGCTAGAAATAGCAAGTTAAAATAAGGCTAGTCCGTTATCAACTTGAAAAAGTGGCACCGAGTCGGTGCtgataataacttttcactTGGGGCCTACAGTACTGCTTatca | 30184 | TGATGTAGAAGGAATCGGGGGTTTTAGAGCTAGAAATAGCAAGTTAAAATAAGGCTAGTCCGTTATCAACTTGAAAAAGTGGCACCGAGTCGGTGC | 30333 |
| 113 | SpyCas9-SpRY | − | TTTAACAGTGATAATAACTTGTTTTAGAGCTAGAAATAGCAAGTTAAAATAAGGCTAGTCCGTTATCAACTTGAAAAAGTGGCACCGAGTCGGTGCtaagcagtactgtaggccCCAAGTGAAAAGTTATTATCactg | 30185 | GTAATAGAGGGGCTGGAACTGTTTTAGAGCTAGAAATAGCAAGTTAAAATAAGGCTAGTCCGTTATCAACTTGAAAAAGTGGCACCGAGTCGGTGC | 30334 |
| 114 | BlatCas9 | − | tgatTTAACAGTGATAATAACTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTaagcagtactgtaggccCCAAGTGAAAAGTTATTATCactg | 30186 | cgtaATAGAGGGGCTGGAACTCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30335 |
| 115 | BlatCas9 | + | ggctTCTCTGATAAGCAGTACTGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTgataataacttttcactTGGGGCCTACAGTACTGCTTatca | 30187 | gcatTTGGGCTGTGATGTAGAAGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30336 |
| 116 | BlatCas9 | − | tgatTTAACAGTGATAATAACTTGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTaagcagtactgtaggccCCAAGTGAAAAGTTATTATCactg | 30188 | cgtaATAGAGGGGCTGGAACTCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30337 |
| 119 | SauCas9KKH | + | GCTTCTCTGATAAGCAGTACTGTTTTAGTACTCTGGAAACAGAATCTACTAAAACAAGGCAAAATGCCGTGTTTATCTCGTCAACTTGTTGGCGAGAgataataacttttcactTGGGGCCTACAGTACTGCTTAtcag | 30189 | GTGATGTAGAAGGAATCGGGGGTTTTAGTACTCTGGAAACAGAATCTACTAAAACAAGGCAAAATGCCGTGTTTATCTCGTCAACTTGTTGGCGAGA | 30338 |
| 120 | SauriCas9-KKH | + | GCTTCTCTGATAAGCAGTACTGTTTTAGTACTCTGGAAACAGAATCTACTAAAACAAGGCAAAATGCCGTGTTTATCTCGTCAACTTGTTGGCGAGAgataataacttttcactTGGGGCCTACAGTACTGCTTAtcag | 30190 | GTGATGTAGAAGGAATCGGGGGTTTTAGTACTCTGGAAACAGAATCTACTAAAACAAGGCAAAATGCCGTGTTTATCTCGTCAACTTGTTGGCGAGA | 30339 |

TABLE 4D-continued

Exemplary template RNA sequences and second nick gRNA spacer sequences

Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 121 | SpyCas9-SpRY | + | CTTCTCTGATAAGCAGTACTGTTTTAGAGCTAGAAATAGCAAGTTAAAATAAGGCTAGTCCGTTATCAACTTGAAAAAGTGGCACCGAGTCGGTGCgataataacttttcactTGGGGCCTACAGTACTGCTTAtcag | 30191 | GATGTAGAAGGAATCGGGGTGTTTTAGAGCTAGAAATAGCAAGTTAAAATAAGGCTAGTCCGTTATCAACTTGAAAAAGTGGCACCGAGTCGGTGC | 30340 |
| 122 | SpyCas9-SpRY | - | ATTTAACAGTGATAATAACTGTTTTAGAGCTAGAAATAGCAAGTTAAAATAAGGCTAGTCCGTTATCAACTTGAAAAAGTGGCACCGAGTCGGTGCaagcagtactgtaggccCCAAGTGAAAAGTTATTATCACtgt | 30192 | TAATAGAGGGGCTGGAACTCGTTTTAGAGCTAGAAATAGCAAGTTAAAATAAGGCTAGTCCGTTATCAACTTGAAAAAGTGGCACCGAGTCGGTGC | 30341 |
| 125 | SauCas9KKH | + | GGCTTCTCTGATAAGCAGTACGTTTTAGTACTCTGGAAACAGAATCTACTAAAACAAGGCAAAATGCCGTGTTTATCTCGTCAACTTGTTGGCGAGAataataacttttcactTGGGGCCTACAGTACTGCTTATcaga | 30193 | ATGTAGAAGGAATCGGGGTGAGTTTTAGTACTCTGGAAACAGAATCTACTAAAACAAGGCAAAATGCCGTGTTTATCTCGTCAACTTGTTGGCGAGA | 30342 |
| 126 | SpyCas9-NG | + | GCTTCTCTGATAAGCAGTACGTTTTAGAGCTAGAAATAGCAAGTTAAAATAAGGCTAGTCCGTTATCAACTTGAAAAAGTGGCACCGAGTCGGTGCataataacttttcactTGGGGCCTACAGTACTGCTTATcaga | 30194 | ATGTAGAAGGAATCGGGGTGGTTTTAGAGCTAGAAATAGCAAGTTAAAATAAGGCTAGTCCGTTATCAACTTGAAAAAGTGGCACCGAGTCGGTGC | 30343 |
| 130 | SpyCas9-SpRY | + | GCTTCTCTGATAAGCAGTACGTTTTAGAGCTAGAAATAGCAAGTTAAAATAAGGCTAGTCCGTTATCAACTTGAAAAAGTGGCACCGAGTCGGTGCataataacttttcactTGGGGCCTACAGTACTGCTTATcaga | 30195 | ATGTAGAAGGAATCGGGGTGGTTTTAGAGCTAGAAATAGCAAGTTAAAATAAGGCTAGTCCGTTATCAACTTGAAAAAGTGGCACCGAGTCGGTGC | 30344 |
| 131 | SpyCas9-SpRY | - | GATTTAACAGTGATAATAACGTTTTAGAGCTAGAAATAGCAAGTTAAAATAAGGCTAGTCCGTTATCAACTTGAAAAAGTGGCACCGAGTCGGTGCagcagtactgtaggccCCAAGTGAAAAGTTATTATCACtgtt | 30196 | AATAGAGGGGCTGGAACTCCGTTTTAGAGCTAGAAATAGCAAGTTAAAATAAGGCTAGTCCGTTATCAACTTGAAAAAGTGGCACCGAGTCGGTGC | 30345 |
| 132 | BlatCas9 | - | cctgATTTAACAGTGATAATAACGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTagcagtactgtaggccCCAAGTGAAAAGTTATTATCACtgtt | 30197 | cgtaATAGAGGGGCTGGAACTCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30346 |
| 136 | ScaCas9-Sc++ | + | GGCTTCTCTGATAAGCAGTAGTTTTAGAGCTAGAAATAGCAAGTTAAAATAAGGCTAGTCCGTTATCAACTTGAAAAAGTGGCACCGAGTCGGTGCtaataacttttcactTGGGGCCTACAGTACTGCTTATCagag | 30198 | GTAGAAGGAATCGGGGTGAGGTTTTAGAGCTAGAAATAGCAAGTTAAAATAAGGCTAGTCCGTTATCAACTTGAAAAAGTGGCACCGAGTCGGTGC | 30347 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 137 | SpyCas9-SpRY | + | GGCTTCTCTGATAAGCAGTAGTTTTAGAGCTAGAAATAGCAAGTTAAAATAAGGCTAGTCCGTTATCAACTTGAAAAAGTGGCACCGAGTCGGTGCtaataacttttcactTGGGGCCTACAGTACTGCTTATCagag | 30199 | TGTAGAAGGAATCGGGGTGAGTTTTAGAGCTAGAAATAGCAAGTTAAAATAAGGCTAGTCCGTTATCAACTTGAAAAAGTGGCACCGAGTCGGTGC | 30348 |
| 138 | SpyCas9-SpRY | - | TGATTTAACAGTGATAATAAGTTTTAGAGCTAGAAATAGCAAGTTAAAATAAGGCTAGTCCGTTATCAACTTGAAAAAGTGGCACCGAGTCGGTGCgcagtactgtaggccCCAAGTGAAAAGTTATTATCACTgtta | 30200 | ATAGAGGGGCTGGAACTCCGGTTTTAGAGCTAGAAATAGCAAGTTAAAATAAGGCTAGTCCGTTATCAACTTGAAAAAGTGGCACCGAGTCGGTGC | 30349 |
| 139 | SpyCas9-SpRY | + | TGGCTTCTCTGATAAGCAGTGTTTTAGAGCTAGAAATAGCAAGTTAAAATAAGGCTAGTCCGTTATCAACTTGAAAAAGTGGCACCGAGTCGGTGCaataacttttcactTGGGGCCTACAGTACTGCTTATCAgaga | 30201 | GTAGAAGGAATCGGGGTGAGGTTTTAGAGCTAGAAATAGCAAGTTAAAATAAGGCTAGTCCGTTATCAACTTGAAAAAGTGGCACCGAGTCGGTGC | 30350 |
| 140 | SpyCas9-SpRY | - | CTGATTTAACAGTGATAATAGTTTTAGAGCTAGAAATAGCAAGTTAAAATAAGGCTAGTCCGTTATCAACTTGAAAAAGTGGCACCGAGTCGGTGCcagtactgtaggccCCAAGTGAAAAGTTATTATCACTGttaa | 30202 | TAGAGGGGCTGGAACTCCGTGTTTTAGAGCTAGAAATAGCAAGTTAAAATAAGGCTAGTCCGTTATCAACTTGAAAAAGTGGCACCGAGTCGGTGC | 30351 |
| 141 | SpyCas9-SpRY | + | TTGGCTTCTCTGATAAGCAGGTTTTAGAGCTAGAAATAGCAAGTTAAAATAAGGCTAGTCCGTTATCAACTTGAAAAAGTGGCACCGAGTCGGTGCataacttttcactTGGGGCCTACAGTACTGCTTATCAGagaa | 30203 | TAGAAGGAATCGGGGTGAGAGTTTTAGAGCTAGAAATAGCAAGTTAAAATAAGGCTAGTCCGTTATCAACTTGAAAAAGTGGCACCGAGTCGGTGC | 30352 |
| 142 | SpyCas9-SpRY | - | CCTGATTTAACAGTGATAATGTTTTAGAGCTAGAAATAGCAAGTTAAAATAAGGCTAGTCCGTTATCAACTTGAAAAAGTGGCACCGAGTCGGTGCagtactgtaggccCCAAGTGAAAAGTTATTATCACTGTtaaa | 30204 | AGAGGGGCTGGAACTCCGTGGTTTTAGAGCTAGAAATAGCAAGTTAAAATAAGGCTAGTCCGTTATCAACTTGAAAAAGTGGCACCGAGTCGGTGC | 30353 |
| 145 | SpyCas9-SpRY | - | TCCTGATTTAACAGTGATAAGTTTTAGAGCTAGAAATAGCAAGTTAAAATAAGGCTAGTCCGTTATCAACTTGAAAAAGTGGCACCGAGTCGGTGCgtactgtaggccCCAAGTGAAAAGTTATTATCACTGTTaaat | 30205 | GAGGGGCTGGAACTCCGTGAGTTTTAGAGCTAGAAATAGCAAGTTAAAATAAGGCTAGTCCGTTATCAACTTGAAAAAGTGGCACCGAGTCGGTGC | 30354 |
| 146 | SpyCas9-SpRY | + | TTTGGCTTCTCTGATAAGCAGTTTTAGAGCTAGAAATAGCAAGTTAAAATAAGGCTAGTCCGTTATCAACTTGAAAAAGTGGCACCGAGTCGGTGCtaacttttcactTGGGGCCTACAGTACTGCTTATCAGAgaag | 30206 | AGAAGGAATCGGGGTGAGATGTTTTAGAGCTAGAAATAGCAAGTTAAAATAAGGCTAGTCCGTTATCAACTTGAAAAAGTGGCACCGAGTCGGTGC | 30355 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 150 | SpyCas9-NG | + | CTTTGGCTTCTCTGATAAGCGTTTTAGAGCTAGAAATAGCAAGTTAAAATAAGGCTAGTCCGTTATCAACTTGAAAAAGTGGCACCGAGTCGGTGCaacttttcactTGGGGCCTACAGTACTGCTTATCAGAGaagc | 30207 | GAAGGAATCGGGGTGAGATGGTTTTAGAGCTAGAAATAGCAAGTTAAAATAAGGCTAGTCCGTTATCAACTTGAAAAAGTGGCACCGAGTCGGTGC | 30356 |
| 154 | SpyCas9-SpRY | + | CTTTGGCTTCTCTGATAAGCGTTTTAGAGCTAGAAATAGCAAGTTAAAATAAGGCTAGTCCGTTATCAACTTGAAAAAGTGGCACCGAGTCGGTGCaacttttcactTGGGGCCTACAGTACTGCTTATCAGAGaagc | 30208 | GAAGGAATCGGGGTGAGATGGTTTTAGAGCTAGAAATAGCAAGTTAAAATAAGGCTAGTCCGTTATCAACTTGAAAAAGTGGCACCGAGTCGGTGC | 30357 |
| 155 | SpyCas9-SpRY | - | ATCCTGATTTAACAGTGATAGTTTTAGAGCTAGAAATAGCAAGTTAAAATAAGGCTAGTCCGTTATCAACTTGAAAAAGTGGCACCGAGTCGGTGCtactgtaggccCCAAGTGAAAAGTTATTATCACTGTTAaatc | 30209 | AGGGGCTGGAACTCCGTGACGTTTTAGAGCTAGAAATAGCAAGTTAAAATAAGGCTAGTCCGTTATCAACTTGAAAAAGTGGCACCGAGTCGGTGC | 30358 |
| 156 | BlatCas9 | + | aagcTTTGGCTTCTCTGATAAGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTAacttttcactTGGGGCCTACAGTACTGCTTATCAGAGaagc | 30210 | ggaaTCGGGGTGAGATGAGAGAAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30359 |
| 157 | BlatCas9 | - | ctgaTCCTGATTTAACAGTGATAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTTactgtaggccCCAAGTGAAAAGTTATTATCACTGTTAaatc | 30211 | cgtaATAGAGGGGCTGGAACTCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30360 |
| 158 | BlatCas9 | + | aagcTTTGGCTTCTCTGATAAGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTAacttttcactTGGGGCCTACAGTACTGCTTATCAGAGaagc | 30212 | ggaaTCGGGGTGAGATGAGAGAAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30361 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 159 | BlatCas9 | - | ctgaTCCTGATTTAACAGTGATAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTtactgtaggccCCAAGTGAAAAGTTATTATCACTGTTAAatc | 30213 | cgtaATAGAGGGGCTGGAACTCCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30362 |
| 164 | SauCas9KKH | - | TGATCCTGATTTAACAGTGATGTTTTAGTACTCTGGAAACAGAATCTACTAAAACAAGGCAAAATGCCGTGTTTATCTCGTCAACTTGTTGGCGAGAactgtaggccCCAAGTGAAAAGTTATTATCACTGTTAAatca | 30214 | GGGGCTGGAACTCCGTGACAGGTTTTAGTACTCTGGAAACAGAATCTACTAAAACAAGGCAAAATGCCGTGTTTATCTCGTCAACTTGTTGGCGAGA | 30363 |
| 167 | ScaCas9-Sc++ | + | GCTTTGGCTTCTCTGATAAGGTTTTAGAGCTAGAAATAGCAAGTTAAAATAAGGCTAGTCCGTTATCAACTTGAAAAAGTGGCACCGAGTCGGTGCacttttcactTGGGGCCTACAGTACTGCTTATCAGAGAagcc | 30215 | AAGGAATCGGGGTGAGATGAGTTTTAGAGCTAGAAATAGCAAGTTAAAATAAGGCTAGTCCGTTATCAACTTGAAAAAGTGGCACCGAGTCGGTGC | 30364 |
| 168 | SpyCas9-SpRY | + | GCTTTGGCTTCTCTGATAAGGTTTTAGAGCTAGAAATAGCAAGTTAAAATAAGGCTAGTCCGTTATCAACTTGAAAAAGTGGCACCGAGTCGGTGCacttttcactTGGGGCCTACAGTACTGCTTATCAGAGAagcc | 30216 | AAGGAATCGGGGTGAGATGAGTTTTAGAGCTAGAAATAGCAAGTTAAAATAAGGCTAGTCCGTTATCAACTTGAAAAAGTGGCACCGAGTCGGTGC | 30365 |
| 169 | SpyCas9-SpRY | - | GATCCTGATTTAACAGTGATGTTTTAGAGCTAGAAATAGCAAGTTAAAATAAGGCTAGTCCGTTATCAACTTGAAAAAGTGGCACCGAGTCGGTGCactgtaggccCCAAGTGAAAAGTTATTATCACTGTTAAatca | 30217 | GGGGCTGGAACTCCGTGACAGTTTTAGAGCTAGAAATAGCAAGTTAAAATAAGGCTAGTCCGTTATCAACTTGAAAAAGTGGCACCGAGTCGGTGC | 30366 |
| 173 | SauriCas9-KKH | + | AAGCTTTGGCTTCTCTGATAAGTTTTAGTACTCTGGAAACAGAATCTACTAAAACAAGGCAAAATGCCGTGTTTATCTCGTCAACTTGTTGGCGAGActtttcactTGGGGCCTACAGTACTGCTTATCAGAGAAgcca | 30218 | AGGAATCGGGGTGAGATGAGAGTTTTAGTACTCTGGAAACAGAATCTACTAAAACAAGGCAAAATGCCGTGTTTATCTCGTCAACTTGTTGGCGAGA | 30367 |
| 174 | SpyCas9-SpRY | - | TGATCCTGATTTAACAGTGAGTTTTAGAGCTAGAAATAGCAAGTTAAAATAAGGCTAGTCCGTTATCAACTTGAAAAAGTGGCACCGAGTCGGTGCctgtaggccCCAAGTGAAAAGTTATTATCACTGTTAAAtcag | 30219 | GGGCTGGAACTCCGTGACAGGTTTTAGAGCTAGAAATAGCAAGTTAAAATAAGGCTAGTCCGTTATCAACTTGAAAAAGTGGCACCGAGTCGGTGC | 30368 |
| 175 | SpyCas9-SpRY | + | AGCTTTGGCTTCTCTGATAAGTTTTAGAGCTAGAAATAGCAAGTTAAAATAAGGCTAGTCCGTTATCAACTTGAAAAAGTGGCACCGAGTCGGTGCcttttcactTGGGGCCTACAGTACTGCTTATCAGAGAAgcca | 30220 | AGGAATCGGGGTGAGATGAGGTTTTAGAGCTAGAAATAGCAAGTTAAAATAAGGCTAGTCCGTTATCAACTTGAAAAAGTGGCACCGAGTCGGTGC | 30369 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 179 | SauCas9KKH | + | GAAGCTTTGGCTTCTCTGATAGTTTTAGTACTCTGGAAACAGAATCTACTAAAACAAGGCAAAATGCCGTGTTTATCTCGTCAACTTGTTGGCGAGAttttcactTGGGGCCTACAGTACTGCTTATCAGAGAAGccaa | 30221 | AGGAATCGGGGTGAGATGAGAGTTTTAGTACTCTGGAAACAGAATCTACTAAAACAAGGCAAAATGCCGTGTTTATCTCGTCAACTTGTTGGCGAGA | 30370 |
| 180 | SauCas9KKH | + | GAAGCTTTGGCTTCTCTGATAGTTTTAGTACTCTGGAAACAGAATCTACTAAAACAAGGCAAAATGCCGTGTTTATCTCGTCAACTTGTTGGCGAGAttttcactTGGGGCCTACAGTACTGCTTATCAGAGAAGccaa | 30222 | AGGAATCGGGGTGAGATGAGAGTTTTAGTACTCTGGAAACAGAATCTACTAAAACAAGGCAAAATGCCGTGTTTATCTCGTCAACTTGTTGGCGAGA | 30371 |
| 183 | SpyCas9-NG | - | AAGCTTTGGCTTCTCTGATAGTTTTAGAGCTAGAAATAGCAAGTTAAAATAAGGCTAGTCCGTTATCAACTTGAAAAAGTGGCACCGAGTCGGTGCttttcactTGGGGCCTACAGTACTGCTTATCAGAGAAGccaa | 30223 | AGGAATCGGGGTGAGATGAGGTTTTAGAGCTAGAAATAGCAAGTTAAAATAAGGCTAGTCCGTTATCAACTTGAAAAAGTGGCACCGAGTCGGTGC | 30372 |
| 187 | SpyCas9-SpRY | + | AAGCTTTGGCTTCTCTGATAGTTTTAGAGCTAGAAATAGCAAGTTAAAATAAGGCTAGTCCGTTATCAACTTGAAAAAGTGGCACCGAGTCGGTGCttttcactTGGGGCCTACAGTACTGCTTATCAGAGAAGccaa | 30224 | GGAATCGGGGTGAGATGAGAGTTTTAGAGCTAGAAATAGCAAGTTAAAATAAGGCTAGTCCGTTATCAACTTGAAAAAGTGGCACCGAGTCGGTGC | 30373 |
| 188 | SpyCas9-SpRY | - | CTGATCCTGATTTAACAGTGGTTTTAGAGCTAGAAATAGCAAGTTAAAATAAGGCTAGTCCGTTATCAACTTGAAAAAGTGGCACCGAGTCGGTGCtgtaggccCCAAGTGAAAAGTTATTATCACTGTTAAATcagg | 30225 | GGCTGGAACTCCGTGACAGTGTTTTAGAGCTAGAAATAGCAAGTTAAAATAAGGCTAGTCCGTTATCAACTTGAAAAAGTGGCACCGAGTCGGTGC | 30374 |
| 191 | SauCas9KKH | - | TACTGATCCTGATTTAACAGTGTTTTAGTACTCTGGAAACAGAATCTACTAAAACAAGGCAAAATGCCGTGTTTATCTCGTCAACTTGTTGGCGAGAgtaggcccCCAAGTGAAAAGTTATTATCACTGTTAAATCagga | 30226 | GGGGCTGGAACTCCGTGACAGGTTTTAGTACTCTGGAAACAGAATCTACTAAAACAAGGCAAAATGCCGTGTTTATCTCGTCAACTTGTTGGCGAGA | 30375 |
| 192 | SauCas9KKH | - | TACTGATCCTGATTTAACAGTGTTTTAGTACTCTGGAAACAGAATCTACTAAAACAAGGCAAAATGCCGTGTTTATCTCGTCAACTTGTTGGCGAGAgtaggcccCCAAGTGAAAAGTTATTATCACTGTTAAATCagga | 30227 | GGGGCTGGAACTCCGTGACAGGTTTTAGTACTCTGGAAACAGAATCTACTAAAACAAGGCAAAATGCCGTGTTTATCTCGTCAACTTGTTGGCGAGA | 30376 |
| 195 | ScaCas9-Sc++ | + | GAAGCTTTGGCTTCTCTGATGTTTTAGAGCTAGAAATAGCAAGTTAAAATAAGGCTAGTCCGTTATCAACTTGAAAAAGTGGCACCGAGTCGGTGCtttcactTGGGGCCTACAGTACTGCTTATCAGAGAAGCcaaa | 30228 | GAATCGGGGTGAGATGAGAGGTTTTAGAGCTAGAAATAGCAAGTTAAAATAAGGCTAGTCCGTTATCAACTTGAAAAAGTGGCACCGAGTCGGTGC | 30377 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 196 | SpyCas9-SpRY | + | GAAGCTTTGGCTTCTCTGATGTTTTAGAGCTAGAAATAGCAAGTTAAAATAAGGCTAGTCCGTTATCAACTTGAAAAAGTGGCACCGAGTCGGTGCtttcactTGGGGCCTACAGTACTGCTTATCAGAGAAGCcaaa | 30229 | GAATCGGGGTGAGATGAGAGGTTTTAGAGCTAGAAATAGCAAGTTAAAATAAGGCTAGTCCGTTATCAACTTGAAAAAGTGGCACCGAGTCGGTGC | 30378 |
| 197 | SpyCas9-SpRY | - | ACTGATCCTGATTTAACAGTGTTTTAGAGCTAGAAATAGCAAGTTAAAATAAGGCTAGTCCGTTATCAACTTGAAAAAGTGGCACCGAGTCGGTGCgtaggcccCCAAGTGAAAAGTTATTATCACTGTTAAATCagga | 30230 | GCTGGAACTCCGTGACAGTGGTTTTAGAGCTAGAAATAGCAAGTTAAAATAAGGCTAGTCCGTTATCAACTTGAAAAAGTGGCACCGAGTCGGTGC | 30379 |
| 201 | SauriCas9-KKH | + | GAGAAGCTTTGGCTTCTCTGAGTTTTAGTACTCTGGAAACAGAATCTACTAAAACAAGGCAAAATGCCGTGTTTATCTCGTCAACTTGTTGGCGAGAttcactTGGGGCCTACAGTACTGCTTATCAGAGAAGCCaaag | 30231 | GAATCGGGGTGAGATGAGAGAGTTTTAGTACTCTGGAAACAGAATCTACTAAAACAAGGCAAAATGCCGTGTTTATCTCGTCAACTTGTTGGCGAGA | 30380 |
| 204 | SpyCas9-NG | - | TACTGATCCTGATTTAACAGGTTTTAGAGCTAGAAATAGCAAGTTAAAATAAGGCTAGTCCGTTATCAACTTGAAAAAGTGGCACCGAGTCGGTGCtaggcccCCAAGTGAAAAGTTATTATCACTGTTAAATCAggat | 30232 | GGGCTGGAACTCCGTGACAGGTTTTAGAGCTAGAAATAGCAAGTTAAAATAAGGCTAGTCCGTTATCAACTTGAAAAAGTGGCACCGAGTCGGTGC | 30381 |
| 207 | SpyCas9-SpRY | + | AGAAGCTTTGGCTTCTCTGAGTTTTAGAGCTAGAAATAGCAAGTTAAAATAAGGCTAGTCCGTTATCAACTTGAAAAAGTGGCACCGAGTCGGTGCttcactTGGGGCCTACAGTACTGCTTATCAGAGAAGCCaaag | 30233 | AATCGGGGTGAGATGAGAGAGTTTTAGAGCTAGAAATAGCAAGTTAAAATAAGGCTAGTCCGTTATCAACTTGAAAAAGTGGCACCGAGTCGGTGC | 30382 |
| 209 | SpyCas9-SpRY | - | TACTGATCCTGATTTAACAGGTTTTAGAGCTAGAAATAGCAAGTTAAAATAAGGCTAGTCCGTTATCAACTTGAAAAAGTGGCACCGAGTCGGTGCtaggcccCCAAGTGAAAAGTTATTATCACTGTTAAATCAggat | 30234 | CTGGAACTCCGTGACAGTGTGTTTTAGAGCTAGAAATAGCAAGTTAAAATAAGGCTAGTCCGTTATCAACTTGAAAAAGTGGCACCGAGTCGGTGC | 30383 |
| 210 | BlatCas9 | + | gggaGAAGCTTTGGCTTCTCTGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTttcactTGGGGCCTACAGTACTGCTTATCAGAGAAGCCaaag | 30235 | ggaaTCGGGGTGAGATGAGAGAAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30384 |
| 211 | BlatCas9 | + | gggaGAAGCTTTGGCTTCTCTGAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGC | 30236 | ggaaTCGGGGTGAGATGAGAGAAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAAT | 30385 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| | | | ATTTATCTCCGAGGTGCTTtcactTGGGGCCTACAGTACTG CTTATCAGAGAAGCCaaag | | AATGACAGACGAGCACCTTGGAGCATTTATCT CCGAGGTGCT | |
| 215 | SauCas9KKH | + | GGAGAAGCTTTGGCTTCTCTGGTTTTAGTACTCTGGAA ACAGAATCTACTAAAACAAGGCAAAATGCCGTGTTTAT CTCGTCAACTTGTTGGCGAGAtcactTGGGGCCTACAGTA CTGCTTATCAGAGAAGCCAaagc | 30237 | GAATCGGGGTGAGATGAGAGAGTTTTAGTAC TCTGGAAACAGAATCTACTAAAACAAGGCAA AATGCCGTGTTTATCTCGTCAACTTGTTGGCG AGA | 30386 |
| 218 | ScaCas9-Sc++ | - | ATACTGATCCTGATTTAACAGTTTTAGAGCTAGAAATA GCAAGTTAAAATAAGGCTAGTCCGTTATCAACTTGAAA AAGTGGCACCGAGTCGGTGCaggccCCAAGTGAAAAGTT ATTATCACTGTTAAATCAGgatc | 30238 | AACTCCGTGACAGTGTAATTGTTTTAGAGCTA GAAATAGCAAGTTAAAATAAGGCTAGTCCGT TATCAACTTGAAAAAGTGGCACCGAGTCGGT GC | 30387 |
| 219 | SpyCas9-SpRY | - | ATACTGATCCTGATTTAACAGTTTTAGAGCTAGAAATA GCAAGTTAAAATAAGGCTAGTCCGTTATCAACTTGAAA AAGTGGCACCGAGTCGGTGCaggccCCAAGTGAAAAGTT ATTATCACTGTTAAATCAGgatc | 30239 | TGGAACTCCGTGACAGTGTAGTTTTAGAGCTA GAAATAGCAAGTTAAAATAAGGCTAGTCCGT TATCAACTTGAAAAAGTGGCACCGAGTCGGT GC | 30388 |
| 220 | SpyCas9-SpRY | + | GAGAAGCTTTGGCTTCTCTGGTTTTAGAGCTAGAAATA GCAAGTTAAAATAAGGCTAGTCCGTTATCAACTTGAAA AAGTGGCACCGAGTCGGTGCtcactTGGGGCCTACAGTAC TGCTTATCAGAGAAGCCAaagc | 30240 | ATCGGGGTGAGATGAGAGAAGTTTTAGAGCT AGAAATAGCAAGTTAAAATAAGGCTAGTCCG TTATCAACTTGAAAAAGTGGCACCGAGTCGGT GC | 30389 |
| 223 | SauCas9KKH | + | GGGAGAAGCTTTGGCTTCTCTGTTTTAGTACTCTGGAA ACAGAATCTACTAAAACAAGGCAAAATGCCGTGTTTAT CTCGTCAACTTGTTGGCGAGAcactTGGGGCCTACAGTA CTGCTTATCAGAGAAGCCAAagct | 30241 | GAATCGGGGTGAGATGAGAGAGTTTTAGTAC TCTGGAAACAGAATCTACTAAAACAAGGCAA AATGCCGTGTTTATCTCGTCAACTTGTTGGCG AGA | 30390 |
| 224 | SauCas9KKH | - | GAATACTGATCCTGATTTAACGTTTTAGTACTCTGGAA ACAGAATCTACTAAAACAAGGCAAAATGCCGTGTTTAT CTCGTCAACTTGTTGGCGAGAggccCCAAGTGAAAAGTT ATTATCACTGTTAAATCAGGatca | 30242 | GGAACTCCGTGACAGTGTAATGTTTTAGTACT CTGGAAACAGAATCTACTAAAACAAGGCAAA ATGCCGTGTTTATCTCGTCAACTTGTTGGCGA GA | 30391 |
| 225 | SauCas9KKH | - | GAATACTGATCCTGATTTAACGTTTTAGTACTCTGGAA ACAGAATCTACTAAAACAAGGCAAAATGCCGTGTTTAT CTCGTCAACTTGTTGGCGAGAggccCCAAGTGAAAAGTT ATTATCACTGTTAAATCAGGatca | 30243 | GGAACTCCGTGACAGTGTAATGTTTTAGTACT CTGGAAACAGAATCTACTAAAACAAGGCAAA ATGCCGTGTTTATCTCGTCAACTTGTTGGCGA GA | 30392 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 226 | SpyCas9-NG | - | AATACTGATCCTGATTTAACGTTTTAGAGCTAGAAATAGCAAGTTAAAATAAGGCTAGTCCGTTATCAACTTGAAAAAGTGGCACCGAGTCGGTGCggccCCAAGTGAAAAGTTATTATCACTGTTAAATCAGGatca | 30244 | ACTCCGTGACAGTGTAATTTGTTTTAGAGCTAGAAATAGCAAGTTAAAATAAGGCTAGTCCGTTATCAACTTGAAAAAGTGGCACCGAGTCGGTGC | 30393 |
| 229 | SpyCas9-SpRY | + | GGAGAAGCTTTGGCTTCTCTGTTTTAGAGCTAGAAATAGCAAGTTAAAATAAGGCTAGTCCGTTATCAACTTGAAAAAGTGGCACCGAGTCGGTGCcactTGGGGCCTACAGTACTGCTTATCAGAGAAGCCAAagct | 30245 | TCGGGGTGAGATGAGAGAAGGTTTTAGAGCTAGAAATAGCAAGTTAAAATAAGGCTAGTCCGTTATCAACTTGAAAAAGTGGCACCGAGTCGGTGC | 30394 |
| 232 | SpyCas9-SpRY | - | AATACTGATCCTGATTTAACGTTTTAGAGCTAGAAATAGCAAGTTAAAATAAGGCTAGTCCGTTATCAACTTGAAAAAGTGGCACCGAGTCGGTGCggccCCAAGTGAAAAGTTATTATCACTGTTAAATCAGGatca | 30246 | GGAACTCCGTGACAGTGTAAGTTTTAGAGCTAGAAATAGCAAGTTAAAATAAGGCTAGTCCGTTATCAACTTGAAAAAGTGGCACCGAGTCGGTGC | 30395 |
| 236 | ScaCas9-Sc++ | - | GAATACTGATCCTGATTTAAGTTTTAGAGCTAGAAATAGCAAGTTAAAATAAGGCTAGTCCGTTATCAACTTGAAAAAGTGGCACCGAGTCGGTGCgccCCAAGTGAAAAGTTATTATCACTGTTAAATCAGGAtcag | 30247 | AACTCCGTGACAGTGTAATTGTTTTAGAGCTAGAAATAGCAAGTTAAAATAAGGCTAGTCCGTTATCAACTTGAAAAAGTGGCACCGAGTCGGTGC | 30396 |
| 237 | SpyCas9-SpRY | - | GAATACTGATCCTGATTTAAGTTTTAGAGCTAGAAATAGCAAGTTAAAATAAGGCTAGTCCGTTATCAACTTGAAAAAGTGGCACCGAGTCGGTGCgccCCAAGTGAAAAGTTATTATCACTGTTAAATCAGGAtcag | 30248 | GAACTCCGTGACAGTGTAATGTTTTAGAGCTAGAAATAGCAAGTTAAAATAAGGCTAGTCCGTTATCAACTTGAAAAAGTGGCACCGAGTCGGTGC | 30397 |
| 238 | SpyCas9-NG | + | GGGAGAAGCTTTGGCTTCTCGTTTTAGAGCTAGAAATAGCAAGTTAAAATAAGGCTAGTCCGTTATCAACTTGAAAAAGTGGCACCGAGTCGGTGCactTGGGGCCTACAGTACTGCTTATCAGAGAAGCCAAAgctt | 30249 | CGGGGTGAGATGAGAGAAGGGTTTTAGAGCTAGAAATAGCAAGTTAAAATAAGGCTAGTCCGTTATCAACTTGAAAAAGTGGCACCGAGTCGGTGC | 30398 |
| 242 | SpyCas9-SpRY | + | GGGAGAAGCTTTGGCTTCTCGTTTTAGAGCTAGAAATAGCAAGTTAAAATAAGGCTAGTCCGTTATCAACTTGAAAAAGTGGCACCGAGTCGGTGCactTGGGGCCTACAGTACTGCTTATCAGAGAAGCCAAAgctt | 30250 | CGGGGTGAGATGAGAGAAGGGTTTTAGAGCTAGAAATAGCAAGTTAAAATAAGGCTAGTCCGTTATCAACTTGAAAAAGTGGCACCGAGTCGGTGC | 30399 |
| 247 | SauriCas9-KKH | - | GGGAATACTGATCCTGATTTAGTTTTAGTACTCTGGAAACAGAATCTACTAAAACAAGGCAAAATGCCGTGTTTATCTCGTCAACTTGTTGGCGAGAccCCAAGTGAAAAGTTATTATCACTGTTAAATCAGGATcagt | 30251 | GAACTCCGTGACAGTGTAATTGTTTTAGTACTCTGGAAACAGAATCTACTAAAACAAGGCAAAATGCCGTGTTTATCTCGTCAACTTGTTGGCGAGA | 30400 |

TABLE 4D-continued

Exemplary template RNA sequences and second nick gRNA spacer sequences

Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 250 | ScaCas9-Sc++ | + | GGGGAGAAGCTTTGGCTTCTGTTTTAGAGCTAGAAATAGCAAGTTAAAATAAGGCTAGTCCGTTATCAACTTGAAAAAGTGGCACCGAGTCGGTGCctTGGGGCCTACAGTACTGCTTATCAGAGAAGCCAAAGcttc | 30252 | TCGGGGTGAGATGAGAGAAGGTTTTAGAGCTAGAAATAGCAAGTTAAAATAAGGCTAGTCCGTTATCAACTTGAAAAAGTGGCACCGAGTCGGTGC | 30401 |
| 251 | SpyCas9-SpRY | - | GGGGAGAAGCTTTGGCTTCTGTTTTAGAGCTAGAAATAGCAAGTTAAAATAAGGCTAGTCCGTTATCAACTTGAAAAAGTGGCACCGAGTCGGTGCctTGGGGCCTACAGTACTGCTTATCAGAGAAGCCAAAGcttc | 30253 | GGGGTGAGATGAGAGAAGGGGTTTTAGAGCTAGAAATAGCAAGTTAAAATAAGGCTAGTCCGTTATCAACTTGAAAAAGTGGCACCGAGTCGGTGC | 30402 |
| 252 | SpyCas9-SpRY | - | GGAATACTGATCCTGATTTAGTTTTAGAGCTAGAAATAGCAAGTTAAAATAAGGCTAGTCCGTTATCAACTTGAAAAAGTGGCACCGAGTCGGTGCcCCCAAGTGAAAAGTTATTATCACTGTTAAATCAGGATcagt | 30254 | AACTCCGTGACAGTGTAATTGTTTTAGAGCTAGAAATAGCAAGTTAAAATAAGGCTAGTCCGTTATCAACTTGAAAAAGTGGCACCGAGTCGGTGC | 30403 |
| 255 | SauCas9KKH | + | AGGGGGAGAAGCTTTGGCTTCGTTTTAGTACTCTGGAAACAGAATCTACTAAAACAAGGCAAAATGCCGTGTTTATCTCGTCAACTTGTTGGCGAGAUTGGGGCCTACAGTACTGCTTATCAGAGAAGCCAAAGCttct | 30255 | GGGGTGAGATGAGAGAAGGGGGTTTTAGTACTCTGGAAACAGAATCTACTAAAACAAGGCAAAATGCCGTGTTTATCTCGTCAACTTGTTGGCGAGA | 30404 |
| 256 | SauCas9KKH | - | AGGGAATACTGATCCTGATTTGTTTTAGTACTCTGGAAACAGAATCTACTAAAACAAGGCAAAATGCCGTGTTTATCTCGTCAACTTGTTGGCGAGAcCCAAGTGAAAAGTTATTATCACTGTTAAATCAGGATCagta | 30256 | GAACTCCGTGACAGTGTAATTGTTTTAGTACTCTGGAAACAGAATCTACTAAAACAAGGCAAAATGCCGTGTTTATCTCGTCAACTTGTTGGCGAGA | 30405 |
| 257 | SauCas9KKH | + | AGGGGGAGAAGCTTTGGCTTCGTTTTAGTACTCTGGAAACAGAATCTACTAAAACAAGGCAAAATGCCGTGTTTATCTCGTCAACTTGTTGGCGAGAtTGGGGCCTACAGTACTGCTTATCAGAGAAGCCAAAGCttct | 30257 | GGGGTGAGATGAGAGAAGGGGGTTTTAGTACTCTGGAAACAGAATCTACTAAAACAAGGCAAAATGCCGTGTTTATCTCGTCAACTTGTTGGCGAGA | 30406 |
| 258 | SauCas9KKH | - | AGGGAATACTGATCCTGATTTGTTTTAGTACTCTGGAAACAGAATCTACTAAAACAAGGCAAAATGCCGTGTTTATCTCGTCAACTTGTTGGCGAGAcCCAAGTGAAAAGTTATTATCACTGTTAAATCAGGATCagta | 30258 | GAACTCCGTGACAGTGTAATTGTTTTAGTACTCTGGAAACAGAATCTACTAAAACAAGGCAAAATGCCGTGTTTATCTCGTCAACTTGTTGGCGAGA | 30407 |
| 261 | SpyCas9-SpRY | - | GGGAATACTGATCCTGATTTGTTTTAGAGCTAGAAATAGCAAGTTAAAATAAGGCTAGTCCGTTATCAACTTGAAAAAGTGGCACCGAGTCGGTGCcCCAAGTGAAAAGTTATTATCACTGTTAAATCAGGATCagta | 30259 | ACTCCGTGACAGTGTAATTTGTTTTAGAGCTAGAAATAGCAAGTTAAAATAAGGCTAGTCCGTTATCAACTTGAAAAAGTGGCACCGAGTCGGTGC | 30408 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 262 | SpyCas9-SpRY | + | GGGGGAGAAGCTTTGGCTTCGTTTTAGAGCTAGAAATAGCAAGTTAAAATAAGGCTAGTCCGTTATCAACTTGAAAAAGTGGCACCGAGTCGGTGCtTGGGGCCTACAGTACTGCTTATCAGAGAAGCCAAAGCttct | 30260 | GGGTGAGATGAGAGAAGGGGGTTTTAGAGCTAGAAATAGCAAGTTAAAATAAGGCTAGTCCGTTATCAACTTGAAAAAGTGGCACCGAGTCGGTGC | 30409 |
| 264 | SpyCas9-SpRY | - | AGGGAATACTGATCCTGATTGTTTTAGAGCTAGAAATAGCAAGTTAAAATAAGGCTAGTCCGTTATCAACTTGAAAAAGTGGCACCGAGTCGGTGCCCAAGTGAAAAGTTATTATCACTGTTAAATCAGGATCAgtat | 30261 | CTCCGTGACAGTGTAATTTTGTTTTAGAGCTAGAAATAGCAAGTTAAAATAAGGCTAGTCCGTTATCAACTTGAAAAAGTGGCACCGAGTCGGTGC | 30410 |
| 265 | SpyCas9-SpRY | + | AGGGGGAGAAGCTTTGGCTTGTTTTAGAGCTAGAAATAGCAAGTTAAAATAAGGCTAGTCCGTTATCAACTTGAAAAAGTGGCACCGAGTCGGTGCTGGGGCCTACAGTACTGCTTATCAGAGAAGCCAAAGCTtctc | 30262 | GGTGAGATGAGAGAAGGGGCGTTTTAGAGCTAGAAATAGCAAGTTAAAATAAGGCTAGTCCGTTATCAACTTGAAAAAGTGGCACCGAGTCGGTGC | 30411 |
| 269 | SpyCas9-SpRY | + | CAGGGGGAGAAGCTTTGGCTGTTTTAGAGCTAGAAATAGCAAGTTAAAATAAGGCTAGTCCGTTATCAACTTGAAAAAGTGGCACCGAGTCGGTGCGGGGCCTACAGTACTGCTTATCAGAGAAGCCAAAGCTTctcc | 30263 | GTGAGATGAGAGAAGGGGCAGTTTTAGAGCTAGAAATAGCAAGTTAAAATAAGGCTAGTCCGTTATCAACTTGAAAAAGTGGCACCGAGTCGGTGC | 30412 |
| 270 | SpyCas9-SpRY | - | CAGGGAATACTGATCCTGATGTTTTAGAGCTAGAAATAGCAAGTTAAAATAAGGCTAGTCCGTTATCAACTTGAAAAAGTGGCACCGAGTCGGTGCCAAGTGAAAAGTTATTATCACTGTTAAATCAGGATCAGtatt | 30264 | TCCGTGACAGTGTAATTTTGGTTTTAGAGCTAGAAATAGCAAGTTAAAATAAGGCTAGTCCGTTATCAACTTGAAAAAGTGGCACCGAGTCGGTGC | 30413 |
| 271 | BlatCas9 | - | cagcAGGGAATACTGATCCTGATGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTCAAGTGAAAAGTTATTATCACTGTTAAATCAGGATCAGtatt | 30265 | actcCGTGACAGTGTAATTTTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30414 |
| 272 | BlatCas9 | - | cagcAGGGAATACTGATCCTGATGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTCAAGTGAAAAGTTATTATCACTGTTAAATCAGGATCAGtatt | 30266 | actcCGTGACAGTGTAATTTTGGGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30415 |

TABLE 4D-continued

Exemplary template RNA sequences and second nick gRNA spacer sequences
Table 4D provides design of RNA components of gene modifying systems for correcting the pathogenic IVS10-11G>A, mutation in PAH. The gRNA spacers from Table 1D were filtered, e.g., filtered by occurrence within 15 nt of the desired editing location and use of a Tier 1 Cas enzyme. For each gRNA ID, this table details the sequence of a complete template RNA, optional second-nick gRNA, and Cas variant for use in a Cas-RT fusion gene modifying polypeptide. For exemplification, PBS sequences and post-edit homology regions (after the location of the edit) are set to 12 nt and 30 nt, respectively. Additionally, a second-nick gRNA is selected with preference for a distance near 100 nt from the first nick and a first preference for a design resulting in a PAM-in system, as described elsewhere in this application.

| ID | Cas species | strand | Template RNA | SEQ ID NO | second-nick gRNA | SEQ ID NO |
|---|---|---|---|---|---|---|
| 273 | SauCas9KKH | - | AGCAGGGAATACTGATCCTGAGTTTTAGTACTCTGGAAACAGAATCTACTAAAACAAGGCAAAATGCCGTGTTTATCTCGTCAACTTGTTGGCGAGAAAGTGAAAAGTTATTATCACTGTTAAATCAGGATCAGTattc | 30267 | CTCCGTGACAGTGTAATTTTGGTTTTAGTACTCTGGAAACAGAATCTACTAAAACAAGGCAAAATGCCGTGTTTATCTCGTCAACTTGTTGGCGAGA | 30416 |
| 274 | SpyCas9-SpRY | + | CCAGGGGGAGAAGCTTTGGCGTTTTAGAGCTAGAAATAGCAAGTTAAAATAAGGCTAGTCCGTTATCAACTTGAAAAAGTGGCACCGAGTCGGTGCGGGCCTACAGTACTGCTTATCAGAGAAGCCAAAGCTTCtccc | 30268 | TGAGATGAGAGAAGGGGCACGTTTTAGAGCTAGAAATAGCAAGTTAAAATAAGGCTAGTCCGTTATCAACTTGAAAAAGTGGCACCGAGTCGGTGC | 30417 |
| 275 | SpyCas9-SpRY | - | GCAGGGAATACTGATCCTGAGTTTTAGAGCTAGAAATAGCAAGTTAAAATAAGGCTAGTCCGTTATCAACTTGAAAAAGTGGCACCGAGTCGGTGCAAGTGAAAAGTTATTATCACTGTTAAATCAGGATCAGTattc | 30269 | CCGTGACAGTGTAATTTTGGGTTTTAGAGCTAGAAATAGCAAGTTAAAATAAGGCTAGTCCGTTATCAACTTGAAAAAGTGGCACCGAGTCGGTGC | 30418 |
| 276 | BlatCas9 | + | gctcCAGGGGGAGAAGCTTTGGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTGGGCCTACAGTACTGCTTATCAGAGAAGCCAAAGCTTCtccc | 30270 | gtgaGATGAGAGAAGGGGCACAAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30419 |
| 277 | BlatCas9 | + | gctcCAGGGGGAGAAGCTTTGGCGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCTGGGCCTACAGTACTGCTTATCAGAGAAGCCAAAGCTTCtccc | 30271 | gtgaGATGAGAGAAGGGGCACAAGCTATAGTTCCTTACTGAAAGGTAAGTTGCTATAGTAAGGGCAACAGACCCGAGGCGTTGGGGATCGCCTAGCCCGTGTTTACGGGCTCTCCCCATATTCAAAATAATGACAGACGAGCACCTTGGAGCATTTATCTCCGAGGTGCT | 30420 |

Capital letters indicate "core nucleotides" while lower case letters indicate "flanking nucleotides." Herein, when an RNA sequence (e.g., a template RNA sequence) is said to comprise a particular sequence (e.g., a sequence of Table 4A, Table 4B, Table 4C, or Table 4D or a portion thereof) that comprises thymine (T), it is of course understood that the RNA sequence may (and frequently does) comprise uracil (U) in place of T. For instance, the RNA sequence may comprise U at every position shown as T in the sequence in Table 4A, Table 4B, Table 4C, or Table 4D. More specifically, the present disclosure provides an RNA sequence according to every template sequence shown in Table 4A, Table 4B, Table 4C, or Table 4D, wherein the RNA sequence has a U in place of each T in the sequence of Table 4A, Table 4B, Table 4C, or Table 4D.

In some embodiments, the systems and methods provided herein may comprise a template sequence listed in any of Tables 5A-5F. Tables 5A-5F provide exemplary template RNA sequences (column 2) designed to be paired with a gene modifying polypeptide to correct a mutation in the PAH gene. The templates in Tables 5A-5F are meant to exemplify the total sequence of: (1) gRNA spacer (e.g., for targeting for first strand nick), (2) gRNA scaffold, (3) RT (heterologous object sequence) sequence, and (4) PBS sequence (e.g., for initiating TPRT at first strand nick).

Lengthy table referenced here

US12544458-20260210-T00002

Please refer to the end of the specification for access instructions.

Lengthy table referenced here

US12544458-20260210-T00003

Please refer to the end of the specification for access instructions.

Lengthy table referenced here

US12544458-20260210-T00004

Please refer to the end of the specification for access instructions.

Lengthy table referenced here

US12544458-20260210-T00005

Please refer to the end of the specification for access instructions.

Lengthy table referenced here

US12544458-20260210-T00006

Please refer to the end of the specification for access instructions.

Lengthy table referenced here

US12544458-20260210-T00007

Please refer to the end of the specification for access instructions.

In some embodiments, the systems and methods provided herein may comprise a template sequence listed in Table 6A. Table 6A provides exemplary template RNA sequences (column 4) and second-nick gRNA spacer sequences (column 3) designed to be paired with a gene modifying polypeptide to correct a R408W mutation in the PAH gene.

TABLE 6A

Exemplary second nick gRNA sequences
Table 6A provides spacer sequences for second-strand targeting gRNAs and relevant characteristics. Second-nick gRNAs in this table are designed to be used in combination with template RNAs comprising the particular spacers noted in Column 6. In some embodiments, a second-nick gRNA is selected with preference for a distance of less than or equal to 100 nt from the first nick (i.e., the nick specified by the template RNA). In some embodiments, a second-nick gRNA is selected with a preference for a PAM-in orientation with the template RNA of the gene modifying system, as described elsewhere in this application.

| Name | Second-nick spacer | SEQ ID NO | Sequence | SEQ ID NO | Exemplary Compatible Spacer |
|---|---|---|---|---|---|
| hPKU_ngRNA_17- | TTACTTCTTTTTTAGGAACA | 37082 | TTACTTCTTTTTTAGGAACAGTTTTAGAGCTAGAAATAGCAAGTTAAAATAAGGCTAGTCCGTTATCAACTTGAAAAAGTGGCACCGAGTCGGTGCTTTT | 37124 | hPKU6 |
| hPKU_ngRNA_24- | TGGCATTTTACTTCTTTTTT | 37083 | TGGCATTTTACTTCTTTTTTGTTTTAGAGCTAGAAATAGCAAGTTAAAATAAGGCTAGTCCGTTATCAACTTGAAAAAGTGGCACCGAGTCGGTGCTTTT | 37125 | hPKU6 |
| hPKU_ngRNA_44- | AGTCTTAAGAGAGTTCTCAG | 37084 | AGTCTTAAGAGAGTTCTCAGGTTTTAGAGCTAGAAATAGCAAGTTAAAATAAGGCTAGTCCGTTATCAACTTGAAAAAGTGGCACCGAGTCGGTGCTTTT | 37126 | hPKU6 |
| hPKU_ngRNA_68- | GAAGGGCACCATTTGGAGAA | 37085 | GAAGGGCACCATTTGGAGAAGTTTTAGAGCTAGAAATAGCAAGTTAAAATAAGGCTAGTCCGTTATCAACTTGAAAAAGTGGCACCGAGTCGGTGCTTTT | 37127 | hPKU6 |
| hPKU_ngRNA_75- | CTTGAGTGAAGGGCACCATT | 37086 | CTTGAGTGAAGGGCACCATTGTTTTAGAGCTAGAAATAGCAAGTTAAAATAAGGCTAGTCCGTTATCAACTTGAAAAAGTGGCACCGAGTCGGTGCTTTT | 37128 | hPKU6 |
| hPKU_ngRNA_57+ | TAAGACTACCTTTCTCCAAA | 37087 | TAAGACTACCTTTCTCCAAAGTTTTAGAGCTAGAAATAGCAAGTTAAAATAAGGCTAGTCCGTTATCAACTTGAAAAAGTGGCACCGAGTCGGTGCTTTT | 37129 | hPKU1, hPKU2, hPKU3, hPKU4, hPKU5 |
| hPKU_ngRNA_85- | AAACCACAGGCTTGAGTGAA | 37088 | AAACCACAGGCTTGAGTGAAGTTTTAGAGCTAGAAATAGCAAGTTAAAATAAGGCTAGTCCGTTATCAACTTGAAAAAGTGGCACCGAGTCGGTGCTTTT | 37130 | hPKU6 |
| hPKU_ngRNA_86- | AAAACCACAGGCTTGAGTGA | 37089 | AAAACCACAGGCTTGAGTGAGTTTTAGAGCTAGAAATAGCAAGTTAAAATAAGGCTAGTCCGTTATCAACTTGAAAAAGTGGCACCGAGTCGGTGCTTTT | 37131 | hPKU6 |

TABLE 6A-continued

Exemplary second nick gRNA sequences

Table 6A provides spacer sequences for second-strand targeting gRNAs and relevant characteristics. Second-nick gRNAs in this table are designed to be used in combination with template RNAs comprising the particular spacers noted in Column 6. In some embodiments, a second-nick gRNA is selected with preference for a distance of less than or equal to 100 nt from the first nick (i.e., the nick specified by the template RNA). In some embodiments, a second-nick gRNA is selected with a preference for a PAM-in orientation with the template RNA of the gene modifying system, as described elsewhere in this application.

| Name | Second-nick spacer | SEQ ID NO | Sequence | SEQ ID NO | Exemplary Compatible Spacer |
|---|---|---|---|---|---|
| hPKU_ngRNA_98- | GTTCCTAAGACCAAAACCAC | 37090 | GTTCCTAAGACCAAAACCACGTTTTAGAGCTAGAAATAGCAAGTTAAAATAAGGCTAGTCCGTTATCAACTTGAAAAAGTGGCACCGAGTCGGTGCTTTT | 37132 | hPKU6 |
| hPKU_ngRNA_79+ | GTGCCCTTCACTCAAGCCTG | 37091 | GTGCCCTTCACTCAAGCCTGGTTTTAGAGCTAGAAATAGCAAGTTAAAATAAGGCTAGTCCGTTATCAACTTGAAAAAGTGGCACCGAGTCGGTGCTTTT | 37133 | hPKU1, hPKU2, hPKU3, hPKU4, hPKU5 |
| hPKU_ngRNA_85+ | TTCACTCAAGCCTGTGGTTT | 37092 | TTCACTCAAGCCTGTGGTTTGTTTTAGAGCTAGAAATAGCAAGTTAAAATAAGGCTAGTCCGTTATCAACTTGAAAAAGTGGCACCGAGTCGGTGCTTTT | 37134 | hPKU1, hPKU2, hPKU3, hPKU4, hPKU5 |
| hPKU_ngRNA_92+ | AAGCCTGTGGTTTTGGTCTT | 37093 | AAGCCTGTGGTTTTGGTCTTGTTTTAGAGCTAGAAATAGCAAGTTAAAATAAGGCTAGTCCGTTATCAACTTGAAAAAGTGGCACCGAGTCGGTGCTTTT | 37135 | hPKU1, hPKU2, hPKU3, hPKU4, hPKU5 |
| hPKU_ngRNA_170- | GTCCAAGACCTCAATCCTTT | 37094 | GTCCAAGACCTCAATCCTTTGTTTTAGAGCTAGAAATAGCAAGTTAAAATAAGGCTAGTCCGTTATCAACTTGAAAAAGTGGCACCGAGTCGGTGCTTTT | 37136 | hPKU6 |
| hPKU_ngRNA_171- | TGTCCAAGACCTCAATCCTT | 37095 | TGTCCAAGACCTCAATCCTTGTTTTAGAGCTAGAAATAGCAAGTTAAAATAAGGCTAGTCCGTTATCAACTTGAAAAAGTGGCACCGAGTCGGTGCTTTT | 37137 | hPKU6 |
| hPKU_ngRNA_152+ | GCTACGACCCATACACCCAA | 37096 | GCTACGACCCATACACCCAAGTTTTAGAGCTAGAAATAGCAAGTTAAAATAAGGCTAGTCCGTTATCAACTTGAAAAAGTGGCACCGAGTCGGTGCTTTT | 37138 | hPKU1, hPKU2, hPKU3, hPKU4, hPKU5 |
| hPKU_ngRNA_159+ | CCCATACACCCAAAGGATTG | 37097 | CCCATACACCCAAAGGATTGGTTTTAGAGCTAGAAATAGCAAGTTAAAATAAGGCTAGTCCGTTATCAACTTGAAAAAGTGGCACCGAGTCGGTGCTTTT | 37139 | hPKU1, hPKU2, hPKU3, hPKU4, hPKU5 |
| hPKU_ngRNA_165+ | CACCCAAAGGATTGAGGTCT | 37098 | CACCCAAAGGATTGAGGTCTGTTTTAGAGCTAGAAATAGCAAGTTAAAATAAGGCTAGTCCGT | 37140 | hPKU1, hPKU2, hPKU3, hPKU4, |

TABLE 6A-continued

Exemplary second nick gRNA sequences
Table 6A provides spacer sequences for second-strand targeting gRNAs and relevant characteristics. Second-nick gRNAs in this table are designed to be used in combination with template RNAs comprising the particular spacers noted in Column 6. In some embodiments, a second-nick gRNA is selected with preference for a distance of less than or equal to 100 nt from the first nick (i.e., the nick specified by the template RNA). In some embodiments, a second-nick gRNA is selected with a preference for a PAM-in orientation with the template RNA of the gene modifying system, as described elsewhere in this application.

| Name | Second-nick spacer | SEQ ID NO | Sequence | SEQ ID NO | Exemplary Compatible Spacer |
|---|---|---|---|---|---|
| | | | TATCAACTTGAAAAAGTGGCACCGAGTCGGT GCTTTT | | hPKU5 |
| hPKU_ngRNA_1 97- | AGCCAAAATCT TAAGCTGCT | 37099 | AGCCAAAATCTTAAGCTGCTGTTTTAGAGCTA GAAATAGCAAGTTAAAATAAGGCTAGTCCGT TATCAACTTGAAAAAGTGGCACCGAGTCGGT GCTTTT | 37141 | hPKU6 |
| hPKU_ngRNA_1 98- | CAGCCAAAATC TTAAGCTGC | 37100 | CAGCCAAAATCTTAAGCTGCGTTTTAGAGCTA GAAATAGCAAGTTAAAATAAGGCTAGTCCGT TATCAACTTGAAAAAGTGGCACCGAGTCGGT GCTTTT | 37142 | hPKU6 |
| hPKU_ngRNA_1 92+ | TACCCAGCAGC TTAAGATTT | 37101 | TACCCAGCAGCTTAAGATTTGTTTTAGAGCTA GAAATAGCAAGTTAAAATAAGGCTAGTCCGT TATCAACTTGAAAAAGTGGCACCGAGTCGGT GCTTTT | 37143 | hPKU1, hPKU2, hPKU3, hPKU4, hPKU5 |
| hPKU_ngRNA_2 24- | TGTAAATTACTT ACTGTTAA | 37102 | TGTAAATTACTTACTGTTAAGTTTTAGAGCTA GAAATAGCAAGTTAAAATAAGGCTAGTCCGT TATCAACTTGAAAAAGTGGCACCGAGTCGGT GCTTTT | 37144 | hPKU6 |
| hPKU_ngRNA_2 47- | AGAAACCGAGT GGCCTCGTA | 37103 | AGAAACCGAGTGGCCTCGTAGTTTTAGAGCTA GAAATAGCAAGTTAAAATAAGGCTAGTCCGT TATCAACTTGAAAAAGTGGCACCGAGTCGGT GCTTTT | 37145 | hPKU6 |
| hPKU_ngRNA_2 31+ | TAAGTAATTTA CACCTTACG | 37104 | TAAGTAATTTACACCTTACGGTTTTAGAGCTA GAAATAGCAAGTTAAAATAAGGCTAGTCCGT TATCAACTTGAAAAAGTGGCACCGAGTCGGT GCTTTT | 37146 | hPKU1, hPKU2, hPKU3, hPKU4, hPKU5 |
| hPKU_ngRNA_2 57- | TCGATTACTGA GAAACCGAG | 37105 | TCGATTACTGAGAAACCGAGGTTTTAGAGCTA GAAATAGCAAGTTAAAATAAGGCTAGTCCGT TATCAACTTGAAAAAGTGGCACCGAGTCGGT GCTTTT | 37147 | hPKU6 |
| hPKU_ngRNA_2 39+ | TTACACCTTACG AGGCCACT | 37106 | TTACACCTTACGAGGCCACTGTTTTAGAGCTA GAAATAGCAAGTTAAAATAAGGCTAGTCCGT TATCAACTTGAAAAAGTGGCACCGAGTCGGT GCTTTT | 37148 | hPKU1, hPKU2, hPKU3, hPKU4, hPKU5 |

TABLE 6A-continued

Exemplary second nick gRNA sequences
Table 6A provides spacer sequences for second-strand targeting gRNAs and relevant characteristics. Second-nick gRNAs in this table are designed to be used in combination with template RNAs comprising the particular spacers noted in Column 6. In some embodiments, a second-nick gRNA is selected with preference for a distance of less than or equal to 100 nt from the first nick (i.e., the nick specified by the template RNA). In some embodiments, a second-nick gRNA is selected with a preference for a PAM-in orientation with the template RNA of the gene modifying system, as described elsewhere in this application.

| Name | Second-nick spacer | SEQ ID NO | Sequence | SEQ ID NO | Exemplary Compatible Spacer |
|---|---|---|---|---|---|
| hPKU_ngRNA_291- | TTTTTCCTATGGCGATGGTA | 37107 | TTTTTCCTATGGCGATGGTAGTTTTAGAGCTAGAAATAGCAAGTTAAAATAAGGCTAGTCCGTTATCAACTTGAAAAAGTGGCACCGAGTCGGTGCTTTT | 37149 | hPKU6 |
| hPKU_ngRNA_292- | ATTTTTCCTATGGCGATGGT | 37108 | ATTTTTCCTATGGCGATGGTGTTTTAGAGCTAGAAATAGCAAGTTAAAATAAGGCTAGTCCGTTATCAACTTGAAAAAGTGGCACCGAGTCGGTGCTTTT | 37150 | hPKU6 |
| hPKU_ngRNA_296- | TATTATTTTTCCTATGGCGA | 37109 | TATTATTTTTCCTATGGCGAGTTTTAGAGCTAGAAATAGCAAGTTAAAATAAGGCTAGTCCGTTATCAACTTGAAAAAGTGGCACCGAGTCGGTGCTTTT | 37151 | hPKU6 |
| hPKU_ngRNA_302- | TAAATTTATTATTTTTCCTA | 37110 | TAAATTTATTATTTTTCCTAGTTTTAGAGCTAGAAATAGCAAGTTAAAATAAGGCTAGTCCGTTATCAACTTGAAAAAGTGGCACCGAGTCGGTGCTTTT | 37152 | hPKU6 |
| hPKU_ngRNA_283+ | TCTTTCCCTACCATCGCCAT | 37111 | TCTTTCCCTACCATCGCCATGTTTTAGAGCTAGAAATAGCAAGTTAAAATAAGGCTAGTCCGTTATCAACTTGAAAAAGTGGCACCGAGTCGGTGCTTTT | 37153 | hPKU1, hPKU2, hPKU3, hPKU4, hPKU5 |
| hPKU_ngRNA_318+ | TTTATTGAAATATTTAATTA | 37112 | TTTATTGAAATATTTAATTAGTTTTAGAGCTAGAAATAGCAAGTTAAAATAAGGCTAGTCCGTTATCAACTTGAAAAAGTGGCACCGAGTCGGTGCTTTT | 37154 | hPKU1, hPKU2, hPKU3, hPKU4, hPKU5 |
| hPKU_ngRNA3b128-wt | TGAGAAGGGCCGAGGTATTG | 37113 | TGAGAAGGGCCGAGGTATTGGTTTTAGAGCTAGAAATAGCAAGTTAAAATAAGGCTAGTCCGTTATCAACTTGAAAAAGTGGCACCGAGTCGGTGCTTTT | 37155 | hPKU6 |
| hPKU_ngRNA3b136-mut | TAGCGAACTGAGAAGGGCCA | 37114 | TAGCGAACTGAGAAGGGCCGGTTTTAGAGCTAGAAATAGCAAGTTAAAATAAGGCTAGTCCGTTATCAACTTGAAAAAGTGGCACCGAGTCGGTGCTTTT | 37156 | hPKU6 |

TABLE 6A-continued

Exemplary second nick gRNA sequences
Table 6A provides spacer sequences for second-strand targeting gRNAs and relevant characteristics. Second-nick gRNAs in this table are designed to be used in combination with template RNAs comprising the particular spacers noted in Column 6. In some embodiments, a second-nick gRNA is selected with preference for a distance of less than or equal to 100 nt from the first nick (i.e., the nick specified by the template RNA). In some embodiments, a second-nick gRNA is selected with a preference for a PAM-in orientation with the template RNA of the gene modifying system, as described elsewhere in this application.

| Name | Second-nick spacer | SEQ ID NO | Sequence | SEQ ID NO | Exemplary Compatible Spacer |
|---|---|---|---|---|---|
| hPKU_ngRNA3b 136-wt | TAGCGAACTGA GAAGGGCCG | 37115 | TAGCGAACTGAGAAGGGCCGGTTTTAGAGCT AGAAATAGCAAGTTAAAATAAGGCTAGTCCG TTATCAACTTGAAAAAGTGGCACCGAGTCGGT GCTTTT | 37157 | hPKU6 |
| hPKU_ngRNA3b 128-mut | TGAGAAGGGCC AAGGTATTG | 37116 | TGAGAAGGGCCAAGGTATTGGTTTTAGAGCT AGAAATAGCAAGTTAAAATAAGGCTAGTCCG TTATCAACTTGAAAAAGTGGCACCGAGTCGGT GCTTTT | 37158 | hPKU6 |
| hPKU_ngRNA3b 136-mut | TAGCGAACTGA GAAGGGCCA | 37117 | TAGCGAACTGAGAAGGGCCAGTTTTAGAGCT AGAAATAGCAAGTTAAAATAAGGCTAGTCCG TTATCAACTTGAAAAAGTGGCACCGAGTCGGT GCTTTT | 37159 | hPKU6 |
| hPKU_ngRNA3b 136-wt | TAGCGAACTGA GAAGGGCCG | 37118 | TAGCGAACTGAGAAGGGCCAGTTTTAGAGCT AGAAATAGCAAGTTAAAATAAGGCTAGTCCG TTATCAACTTGAAAAAGTGGCACCGAGTCGGT GCTTTT | 37160 | hPKU6 |
| hPKU_ngRNA_1 16+ | ACTTTGCTGCCA CAATACCT | 37119 | ACTTTGCTGCCACAATACCTGTTTTAGAGCTA GAAATAGCAAGTTAAAATAAGGCTAGTCCGT TATCAACTTGAAAAAGTGGCACCGAGTCGGT GCTTTT | 37161 | hPKU1, hPKU2, hPKU3, hPKU4, hPKU5 |
| hPKU_ngRNA_1 42- | GGGTCGTAGCG AACTGAGAA | 37120 | GGGTCGTAGCGAACTGAGAAGTTTTAGAGCT AGAAATAGCAAGTTAAAATAAGGCTAGTCCG TTATCAACTTGAAAAAGTGGCACCGAGTCGGT GCTTTT | 37162 | hPKU6 |
| hPKU_ngRNA_1 43- | TGGGTCGTAGC GAACTGAGA | 37121 | TGGGTCGTAGCGAACTGAGAGTTTTAGAGCTA GAAATAGCAAGTTAAAATAAGGCTAGTCCGT TATCAACTTGAAAAAGTGGCACCGAGTCGGT GCTTTT | 37163 | hPKU6 |
| hPKU_ngRNA_1 62- | CCTCAATCCTTT GGGTGTAT | 37122 | CCTCAATCCTTTGGGTGTATGTTTTAGAGCTA GAAATAGCAAGTTAAAATAAGGCTAGTCCGT TATCAACTTGAAAAAGTGGCACCGAGTCGGT GCTTTT | 37164 | hPKU6 |

TABLE 6A-continued

Exemplary second nick gRNA sequences
Table 6A provides spacer sequences for second-strand targeting gRNAs and relevant characteristics. Second-nick gRNAs in this table are designed to be used in combination with template RNAs comprising the particular spacers noted in Column 6. In some embodiments, a second-nick gRNA is selected with preference for a distance of less than or equal to 100 nt from the first nick (i.e., the nick specified by the template RNA). In some embodiments, a second-nick gRNA is selected with a preference for a PAM-in orientation with the template RNA of the gene modifying system, as described elsewhere in this application.

| Name | Second-nick spacer | SEQ ID NO | Sequence | SEQ ID NO | Exemplary Compatible Spacer |
|---|---|---|---|---|---|
| hPKU_ngRNA_163- | ACCTCAATCCTTTGGGTGTA | 37123 | ACCTCAATCCTTTGGGTGTAGTTTTAGAGCTAGAAATAGCAAGTTAAAATAAGGCTAGTCCGTTATCAACTTGAAAAAGTGGCACCGAGTCGGTGCTTTT | 37165 | hPKU6 |

The template RNA sequences shown in Tables 1-4, 5A-5F, and 6A may be customized depending on the cell being targeted. For example, in some embodiments it is desired to inactivate a PAM sequence upon editing (e.g., using a “PAM-kill” modification) to decrease the potential for further gene editing (e.g., by Cas retargeting) following the initial edit. Consequently, certain template RNAs described herein are designed to write a mutation (e.g., a substitution) into the PAM of the target site, such that upon editing, the PAM site will be mutated to a sequence no longer recognized by the gene modifying polypeptide. Thus, a mutation region within the heterologous object sequence of the template RNA may comprise a PAM-kill sequence. Without wishing to be bound by theory, in some embodiments, a PAM-kill sequence prevents re-engagement of the gene modifying polypeptide upon completion of a genetic modification, or decreases re-engagement relative to a template RNA lacking a PAM-kill sequence. In some embodiments, a PAM-kill sequence does not alter the amino acid sequence encoded by a gene, e.g., the PAM-kill sequence results in a silent mutation. In other embodiments, it is desired to leave the PAM sequence intact (no PAM-kill).

Similarly, in some embodiments, to decrease the potential for further gene editing (e.g., by Cas retargeting) following the initial edit, it may be desirable to alter the first three nucleotides of the RT template sequence via a “seed-kill” motif. Consequently, certain template RNAs described herein are designed to write a mutation (e.g., a substitution) into the portion of the target site corresponding to the first three nucleotides of the RT template sequence, such that upon editing, the target site will be mutated to a sequence with lower homology to the RT template sequence. Thus, a mutation region within the heterologous object sequence of the template RNA may comprise a seed-kill sequence. Without wishing to be bound by theory, in some embodiments, a seed-kill sequence prevents re-engagement of the gene modifying polypeptide upon completion of a genetic modification, or decreases re-engagement relative to an otherwise similar template RNA lacking a seed-kill sequence. In some embodiments, a seed-kill sequence does not alter the amino acid sequence encoded by a gene, e.g., the seed-kill sequence results in a silent mutation. In other embodiments, it is desired to leave the seed region intact, and a seed-kill sequence is not used.

In further embodiments, to optimize or improve gene editing efficiency, it may be desirable to evade the target cell’s mismatch repair or nucleotide repair pathways or to bias the target cell’s repair pathways toward preservation of the edited strand. In some embodiments, multiple silent mutations (for example, silent substitutions) may be introduced within the RT template sequence to evade the target cell’s mismatch repair or nucleotide repair pathways or to bias the target cell’s repair pathways toward preservation of the edited strand.

Table 7A provides exemplary silent mutations for various positions within the PAH gene for use with a template to correct a R408W mutation.

TABLE 7A

Exemplary Silent Mutation Codons for the PAH Gene for Templates to Correct a R408W mutation

| Amino Acid Position (Including the Initial Methionine) | WT Amino Acid | WT Codon | ALL CODONS | | | | | |
|---|---|---|---|---|---|---|---|---|
| 401 | N | AAC | AAT | AAC | | | | |
| 402 | F | TTT | TTT | TTC | | | | |
| 403 | A | GCT | GCT | GCC | GCA | GCG | | |
| 404 | A | GCC | GCT | GCC | GCA | GCG | | |
| 405 | T | ACA | ACT | ACC | ACA | ACG | | |
| 406 | I | ATA | ATA | ATT | ATC | | | |
| 407 | P | CCT | CCT | CCC | CCA | CCG | | |
| 409 | P | CCC | CCT | CCC | CCA | CCG | | |
| 410 | F | TTC | TTT | TTC | | | | |
| 411 | S | TCA | TCT | TCC | TCA | TCG | AGT | AGC |
| 412 | V | GTT | GTT | GTC | GTA | GTG | | |
| 413 | R | CGC | CGT | CGC | CGA | CGG | AGA | AGG |
| 414 | Y | TAC | TAT | TAC | | | | |
| 415 | D | GAC | GAT | GAC | | | | |
| 416 | P | CCA | CCT | CCC | CCA | CCG | | |
| 417 | Y | TAC | TAT | TAC | | | | |
| 418 | T | ACC | ACT | ACC | ACA | ACG | | |
| 419 | Q | CAA | CAA | CAG | | | | |
| 420 | R | AGG | CGT | CGC | CGA | CGG | AGA | AGG |
| 421 | I | ATT | ATA | ATT | ATC | | | |
| 422 | E | GAG | GAA | GAG | | | | |
| 423 | V | GTC | GTT | GTC | GTA | GTG | | |
| 424 | L | TTG | TTA | TTG | CTT | CTC | CTA | CTG |
| 425 | D | GAC | GAT | GAC | | | | |
| 426 | N | AAT | AAT | AAC | | | | |
| 427 | T | ACC | ACT | ACC | ACA | ACG | | |
| 428 | Q | CAG | CAA | CAG | | | | |
| 429 | Q | CAG | CAA | CAG | | | | |
| 430 | L | CTT | TTA | TTG | CTT | CTC | CTA | CTG |
| 431 | K | AAG | AAA | AAG | | | | |
| 432 | I | ATT | ATA | ATT | ATC | | | |
| 433 | L | TTG | TTA | TTG | CTT | CTC | CTA | CTG |
| 434 | A | GCT | GCT | GCC | GCA | GCG | | |
| 435 | D | GAT | GAT | GAC | | | | |
| 436 | S | TCC | TCT | TCC | TCA | TCG | AGT | AGC |
| 437 | I | ATT | ATA | ATT | ATC | | | |
| 438 | N | AAC | AAT | AAC | | | | |

Table 7B provides exemplary silent mutations for various positions within the PAH gene for use with a template to correct a R261Q mutation.

TABLE 7B

Exemplary Silent Mutation Codons for the PAH Gene for Templates to Correct a R261Q mutation

| Amino Acid Position (Including the Initial Methionine) | WT Amino Acid | WT Codon | All Codons | | | | | |
|---|---|---|---|---|---|---|---|---|
| 237 | C | TGC | TGT | TGC | | | | |
| 238 | T | ACT | ACT | ACC | ACA | ACG | | |
| 239 | G | GGT | GGT | GGC | GGA | GGG | | |
| 240 | F | TTC | TTT | TTC | | | | |
| 241 | R | CGC | CGT | CGC | CGA | CGG | AGA | AGG |
| 242 | L | CTC | TTA | TTG | CTT | CTC | CTA | CTG |
| 243 | R | CGA | CGT | CGC | CGA | CGG | AGA | AGG |
| 244 | P | CCT | CCT | CCC | CCA | CCG | | |
| 245 | V | GTG | GTT | GTC | GTA | GTG | | |
| 246 | A | GCT | GCT | GCC | GCA | GCG | | |
| 247 | G | GGC | GGT | GGC | GGA | GGG | | |
| 248 | L | CTG | TTA | TTG | CTT | CTC | CTA | CTG |
| 249 | L | CTT | TTA | TTG | CTT | CTC | CTA | CTG |
| 250 | S | TCC | TCT | TCC | TCA | TCG | AGT | AGC |
| 251 | S | TCT | TCT | TCC | TCA | TCG | AGT | AGC |
| 252 | R | CGG | CGT | CGC | CGA | CGG | AGA | AGG |

TABLE 7B-continued

| Exemplary Silent Mutation Codons for the PAH Gene for Templates to Correct a R261Q mutation | | | | | | | | |
|---|---|---|---|---|---|---|---|---|
| Amino Acid Position (Including the Initial Methionine) | WT Amino Acid | WT Co-don | All Codons | | | | | |
| 253 | D | GAT | GAT | GAC | | | | |
| 254 | F | TTC | TTT | TTC | | | | |
| 255 | L | TTG | TTA | TTG | CTT | CTC | CTA | CTG |
| 256 | G | GGT | GGT | GGC | GGA | GGG | | |
| 257 | G | GGC | GGT | GGC | GGA | GGG | | |
| 258 | L | CTG | TTA | TTG | CTT | CTC | CTA | CTG |
| 259 | A | GCC | GCT | GCC | GCA | GCG | | |
| 260 | F | TTC | TTT | TTC | | | | |
| 262 | V | GTC | GTT | GTC | GTA | GTG | | |
| 263 | F | TTC | TTT | TTC | | | | |
| 264 | H | CAC | CAT | CAC | | | | |
| 265 | C | TGC | TGT | TGC | | | | |
| 266 | T | ACA | ACT | ACC | ACA | ACG | | |
| 267 | Q | CAG | CAA | CAG | | | | |
| 268 | Y | TAC | TAT | TAC | | | | |
| 269 | I | ATC | ATA | ATT | ATC | | | |
| 270 | R | AGA | CGT | CGC | CGA | CGG | AGA | AGG |
| 271 | H | CAT | CAT | CAC | | | | |
| 272 | G | GGA | GGT | GGC | GGA | GGG | | |
| 273 | S | TCC | TCT | TCC | TCA | TCG | AGT | AGC |
| 274 | K | AAG | AAA | AAG | | | | |
| 275 | P | CCC | CCT | CCC | CCA | CCG | | |
| 276 | M | ATG | ATG | | | | | |
| 277 | Y | TAT | TAT | TAC | | | | |
| 278 | T | ACC | ACT | ACC | ACA | ACG | | |
| 279 | P | CCC | CCT | CCC | CCA | CCG | | |
| 280 | E | GAA | GAA | GAG | | | | |

Table 7C provides exemplary silent mutations for various positions within the PAH gene for use with a template to correct a R243Q mutation.

TABLE 7C

| Exemplary Silent Mutation Codons for the PAH Gene for Templates to Correct a R243Q mutation | | | | | | | | |
|---|---|---|---|---|---|---|---|---|
| Amino Acid Position (Including the Initial Methionine) | WT Amino Acid | WT Codon | ALL CODONS | | | | | |
| 237 | C | TGC | TGT | TGC | | | | |
| 238 | T | ACT | ACT | ACC | ACA | ACG | | |
| 239 | G | GGT | GGT | GGC | GGA | GGG | | |
| 240 | F | TTC | TTT | TTC | | | | |
| 241 | R | CGC | CGT | CGC | CGA | CGG | AGA | AGG |
| 242 | L | CTC | TTA | TTG | CTT | CTC | CTA | CTG |
| 244 | P | CCT | CCT | CCC | CCA | CCG | | |
| 245 | V | GTG | GTT | GTC | GTA | GTG | | |
| 246 | A | GCT | GCT | GCC | GCA | GCG | | |
| 247 | G | GGC | GGT | GGC | GGA | GGG | | |
| 248 | L | CTG | TTA | TTG | CTT | CTC | CTA | CTG |
| 249 | L | CTT | TTA | TTG | CTT | CTC | CTA | CTG |
| 250 | S | TCC | TCT | TCC | TCA | TCG | AGT | AGC |
| 251 | S | TCT | TCT | TCC | TCA | TCG | AGT | AGC |
| 252 | R | CGG | CGT | CGC | CGA | CGG | AGA | AGG |
| 253 | D | GAT | GAT | GAC | | | | |
| 254 | F | TTC | TTT | TTC | | | | |
| 255 | L | TTG | TTA | TTG | CTT | CTC | CTA | CTG |
| 256 | G | GGT | GGT | GGC | GGA | GGG | | |
| 257 | G | GGC | GGT | GGC | GGA | GGG | | |
| 258 | L | CTG | TTA | TTG | CTT | CTC | CTA | CTG |
| 259 | A | GCC | GCT | GCC | GCA | GCG | | |
| 260 | F | TTC | TTT | TTC | | | | |
| 261 | R | CGA | CGT | CGC | CGA | CGG | AGA | AGG |
| 262 | V | GTC | GTT | GTC | GTA | GTG | | |
| 263 | F | TTC | TTT | TTC | | | | |
| 264 | H | CAC | CAT | CAC | | | | |
| 265 | C | TGC | TGT | TGC | | | | |
| 266 | T | ACA | ACT | ACC | ACA | ACG | | |
| 267 | Q | CAG | CAA | CAG | | | | |
| 268 | Y | TAC | TAT | TAC | | | | |
| 269 | I | ATC | ATA | ATT | ATC | | | |
| 270 | R | AGA | CGT | CGC | CGA | CGG | AGA | AGG |
| 271 | H | CAT | CAT | CAC | | | | |
| 272 | G | GGA | GGT | GGC | GGA | GGG | | |
| 273 | S | TCC | TCT | TCC | TCA | TCG | AGT | AGC |
| 274 | K | AAG | AAA | AAG | | | | |
| 275 | P | CCC | CCT | CCC | CCA | CCG | | |
| 276 | M | ATG | ATG | | | | | |

TABLE 7C-continued

| Exemplary Silent Mutation Codons for the PAH Gene for Templates to Correct a R243Q mutation | | | | | | |
|---|---|---|---|---|---|---|
| Amino Acid Position (Including the Initial Methionine) | WT Amino Acid | WT Codon | ALL CODONS | | | |
| 277 | Y | TAT | TAT | TAC | | |
| 278 | T | ACC | ACT | ACC | ACA | ACG |
| 279 | P | CCC | CCT | CCC | CCA | CCG |
| 280 | E | GAA | GAA | GAG | | |

In some embodiments, the template RNA comprises one or more silent mutations.

It should be understood that the silent mutations illustrated in Tables 7A-7C may be used individually or combined in any manner in a template RNA sequence described herein. In some embodiments, the template RNA comprises a sequence having one or more silent substitutions as shown in Table E6 or E6A.

In some embodiments, the template RNA comprises a sequence listed in any one of Tables 8A-8D. Tables 8A-8D provide exemplary template RNA sequences comprising one or more silent substitutions (column 2) designed to be paired with a gene modifying polypeptide to correct a mutation in the PAH gene. The templates in Tables 5A-5F are meant to exemplify the total sequence of: (1) gRNA spacer (e.g., for targeting for first strand nick), (2) gRNA scaffold, (3) RT (heterologous object sequence) sequence, and (4) PBS sequence (e.g., for initiating TPRT at first strand nick).

TABLE 8A

Exemplary template RNA sequences

Table 8A provides design of exemplary components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU3 spacer TGGGTCGTAGCGAACTGAGA (SEQ ID NO: 16102).

| Name | tgRNA sequence | SEQ ID NO |
|---|---|---|
| hPKU3_R17_P10_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaatacctCggcccttctcagttcgcta | 36542 |
| hPKU3_R17_P10_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaataccgCggcccttctcagttcgcta | 36543 |
| hPKU3_R17_P10_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaatccctCggcccttctcagttcgcta | 36544 |
| hPKU3_R17_P10_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaatacctCgccccttctcagttcgcta | 36545 |
| hPKU3_R17_P10_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaataccgCgccccttctcagttcgcta | 36546 |
| hPKU3_R17_P10_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaataccgCgcccattctcagttcgcta | 36547 |
| hPKU3_R17_P8_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaatacctCggcccttctcagttcgc | 36548 |
| hPKU3_R17_P8_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaataccgCggcccttctcagttcgc | 36549 |
| hPKU3_R17_P8_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaatccctCggcccttctcagttcgc | 36550 |
| hPKU3_R17_P8_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaatacctCgccccttctcagttcgc | 36551 |
| hPKU3_R17_P8_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaataccgCgccccttctcagttcgc | 36552 |
| hPKU3_R17_P8_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaataccgCgcccattctcagttcgc | 36553 |
| hPKU3_R17_P9_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaatacctCggcccttctcagttcgct | 36554 |

TABLE 8A-continued

Exemplary template RNA sequences
Table 8A provides design of exemplary components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU3 spacer TGGGTCGTAGCGAACTGAGA (SEQ ID NO: 16102).

| Name | tgRNA sequence | SEQ ID NO |
|---|---|---|
| hPKU3_R17_P9_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaataccgCggcccttctcagttcgct | 36555 |
| hPKU3_R17_P9_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaatccctCggcccttctcagttcgct | 36556 |
| hPKU3_R17_P9_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaatacctCgcccccttctcagttcgct | 36557 |
| hPKU3_R17_P9_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaataccgCgccccttctcagttcgct | 36558 |
| hPKU3_R17_P9_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCaataccgCgcccattctcagttcgct | 36559 |
| hPKU3_R19_P10_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaatacctCggcccttctcagttcgcta | 36560 |
| hPKU3_R19_P10_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaataccgCggcccttctcagttcgcta | 36561 |
| hPKU3_R19_P10_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaatccctCggcccttctcagttcgcta | 36562 |
| hPKU3_R19_P10_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaatacctCgccccttctcagttcgcta | 36563 |
| hPKU3_R19_P10_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaataccgCgccccttctcagttcgcta | 36564 |
| hPKU3_R19_P10_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaataccgCgcccattctcagttcgcta | 36565 |
| hPKU3_R19_P8_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaatacctCggcccttctcagttcgc | 36566 |
| hPKU3_R19_P8_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaataccgCggcccttctcagttcgc | 36567 |
| hPKU3_R19_P8_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaatccctCggcccttctcagttcgc | 36568 |
| hPKU3_R19_P8_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaatacctCgccccttctcagttcgc | 36569 |
| hPKU3_R19_P8_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaataccgCgccccttctcagttcgc | 36570 |
| hPKU3_R19_P8_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaataccgCgcccattctcagttcgc | 36571 |
| hPKU3_R19_P9_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaatacctCggcccttctcagttcgct | 36572 |
| hPKU3_R19_P9_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaataccgCggcccttctcagttcgct | 36573 |
| hPKU3_R19_P9_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaatccctCggcccttctcagttcgct | 36574 |
| hPKU3_R19_P9_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaatacctCgccccttctcagttcgct | 36575 |
| hPKU3_R19_P9_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaataccgCgccccttctcagttcgct | 36576 |
| hPKU3_R19_P9_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCacaataccgCgcccattctcagttcgct | 36577 |

TABLE 8A-continued

Exemplary template RNA sequences
Table 8A provides design of exemplary components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU3 spacer TGGGTCGTAGCGAACTGAGA (SEQ ID NO: 16102).

| Name | tgRNA sequence | SEQ ID NO |
|---|---|---|
| hPKU3_R21_ P10_sub0 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaatacctCggcccttctcagttcgcta | 36578 |
| hPKU3_R21_ P10_sub1 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaataccgCggcccttctcagttcgcta | 36579 |
| hPKU3_R21_ P10_sub2 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaatccctCggcccttctcagttcgcta | 36580 |
| hPKU3_R21_ P10_sub4 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaatacctCgccccttctcagttcgcta | 36581 |
| hPKU3_R21_ P10_sub7 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaataccgCgccccttctcagttcgcta | 36582 |
| hPKU3_R21_ P10_sub8 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaataccgCgcccattctcagttcgcta | 36583 |
| hPKU3_R21_ P8_sub0 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaatacctCggcccttctcagttcgc | 36584 |
| hPKU3_R21_ P8_sub1 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaataccgCggcccttctcagttcgc | 36585 |
| hPKU3_R21_ P8_sub2 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaatccctCggcccttctcagttcgc | 36586 |
| hPKU3_R21_ P8_sub4 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaatacctCgccccttctcagttcgc | 36587 |
| hPKU3_R21 P8_sub7 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaataccgCgccccttctcagttcgc | 36588 |
| hPKU3_R21_ P8_sub8 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaataccgCgcccattctcagttcgc | 36589 |
| hPKU3_R21_ P9_sub0 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaatacctCggcccttctcagttcgct | 36590 |
| hPKU3_R21_ P9_sub1 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaataccgCggcccttctcagttcgct | 36591 |
| hPKU3_R21_ P9_sub2 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaatccctCggcccttctcagttcgct | 36592 |
| hPKU3_R21_ P9_sub4 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaatacctCgccccttctcagttcgct | 36593 |
| hPKU3_R21_ P9_sub7 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaataccgCgccccttctcagttcgct | 36594 |
| hPKU3_R21_ P9_sub8 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCccacaataccgCgcccattctcagttcgct | 36595 |
| hPKU3_R23_ P10_sub0 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCtgccacaatacctCggcccttctcagttcgcta | 36596 |
| hPKU3_R23_ P10_sub1 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCtgccacaataccgCggcccttctcagttcgcta | 36597 |
| hPKU3_R23_ P10_sub2 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCtgccacaatccctCggcccttctcagttcgcta | 36598 |
| hPKU3_R23_ P10_sub4 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCtgccacaatacctCgccccttctcagttcgcta | 36599 |
| hPKU3_R23_ P10_sub7 | TGGGTCGTAGCGAACTGAGAGTTTTAGAGCTAGAAATAGCAAGTTAAAATAAGGCTAGTCCGTTATCAACTTGAAAAAGTGGC ACCGAGTCGGTGCtgccacaataccgCgccccttctcagttcgcta | 36600 |

TABLE 8A-continued

Exemplary template RNA sequences
Table 8A provides design of exemplary components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU3 spacer TGGGTCGTAGCGAACTGAGA (SEQ ID NO: 16102).

| Name | tgRNA sequence | SEQ ID NO |
|---|---|---|
| hPKU3_R23_P10_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaataccgCgcccattctcagttcgcta | 36601 |
| hPKU3_R23_P8_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaatacctCggcccttctcagttcgc | 36602 |
| hPKU3_R23_P8_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaataccgCggcccttctcagttcgc | 36603 |
| hPKU3_R23_P8_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaatccctCggcccttctcagttcgc | 36604 |
| hPKU3_R23_P8_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaatacctCgccccttctcagttcgc | 36605 |
| hPKU3_R23_P8_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaataccgCgccccttctcagttcgc | 36606 |
| hPKU3_R23_P8_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaataccgCgcccattctcagttcgc | 36607 |
| hPKU3_R23_P9_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaatacctCggcccttctcagttcgct | 36608 |
| hPKU3_R23_P9_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaataccgCggcccttctcagttcgct | 36609 |
| hPKU3_R23_P9_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaatccctCggcccttctcagttcgct | 36610 |
| hPKU3_R23_P9_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaatacctCgccccttctcagttcgct | 36611 |
| hPKU3_R23_P9_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaataccgCgccccttctcagttcgct | 36612 |
| hPKU3_R23_P9_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCtgccacaataccgCgcccattctcagttcgct | 36613 |
| hPKU3_R25_P10_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaatacctCggcccttctcagttcgcta | 36614 |
| hPKU3_R25_P10_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaataccgCggcccttctcagttcgcta | 36615 |
| hPKU3_R25_P10_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaatccctCggcccttctcagttcgcta | 36616 |
| hPKU3_R25_P10_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaatacctCgccccttctcagttcgcta | 36617 |
| hPKU3_R25_P10_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaataccgCgccccttctcagttcgcta | 36618 |
| hPKU3_R25_P10_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaataccgCgcccattctcagttcgcta | 36619 |
| hPKU3_R25_P8_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaatacctCggcccttctcagttcgc | 36620 |
| hPKU3_R25_P8_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaataccgCggcccttctcagttcgc | 36621 |
| hPKU3_R25_P8_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaatccctCggcccttctcagttcgc | 36622 |
| hPKU3_R25_P8_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaatacctCgccccttctcagttcgc | 36623 |

TABLE 8A-continued

Exemplary template RNA sequences
Table 8A provides design of exemplary components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU3 spacer TGGGTCGTAGCGAACTGAGA (SEQ ID NO: 16102).

| Name | tgRNA sequence | SEQ ID NO |
|---|---|---|
| hPKU3_R25_P8_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaataccgCgcccccttctcagttcgc | 36624 |
| hPKU3_R25_P8_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaataccgCgcccattctcagttcgc | 36625 |
| hPKU3_R25_P9_sub0 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaatacctCggcccttctcagttcgct | 36626 |
| hPKU3_R25_P9_sub1 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaataccgCggcccttctcagttcgct | 36627 |
| hPKU3_R25_P9_sub2 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaatccctCggcccttctcagttcgct | 36628 |
| hPKU3_R25_P9_sub4 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaatacctCgcccccttctcagttcgct | 36629 |
| hPKU3_R25_P9_sub7 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaataccgCgcccccttctcagttcgct | 36630 |
| hPKU3_R25_P9_sub8 | TGGGTCGTAGCGAACTGAGAGTTTTAGAGCTAGAAATAGCAAGTTAAAATAAGGCTAGTCCGTTATCAACTTGAAAAAGTGGCACCGAGTCGGTGCgctgccacaataccgCgcccattctcagttcgct | 36631 |

TABLE 8B

Exemplary template RNA sequences
Table 8B provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU4 spacer GGGTCGTAGCGAACTGAGAA (SEQ ID NO: 16084).

| Name | tgRNA sequence | SEQ ID NO |
|---|---|---|
| hPKU4_R16_P10_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaatacctCggcccttctcagttcgct | 36632 |
| hPKU4_R16_P10_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaataccgCggcccttctcagttcgct | 36633 |
| hPKU4_R16_P10_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaatacctCgcccccttctcagttcgct | 36634 |
| hPKU4_R16_P10_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaatacctCgcccattctcagttcgct | 36635 |
| hPKU4_R16_P10_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaataccgCgcccccttctcagttcgct | 36636 |
| hPKU4_R16_P10_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaataccgCgcccattctcagttcgct | 36637 |
| hPKU4_R16_P8_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaatacctCggcccttctcagttcg | 36638 |
| hPKU4_R16_P8_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaataccgCggcccttctcagttcg | 36639 |
| hPKU4_R16_P8_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaatacctCgcccccttctcagttcg | 36640 |
| hPKU4_R16_P8_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaatacctCgcccattctcagttcg | 36641 |

TABLE 8B-continued

Exemplary template RNA sequences
Table 8B provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU4 spacer GGGTCGTAGCGAACTGAGAA (SEQ ID NO: 16084).

| Name | tgRNA sequence | SEQ ID NO |
|---|---|---|
| hPKU4_R16_P8_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaataccgCgccccttctcagttcg | 36642 |
| hPKU4_R16_P8_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaataccgCgcccattctcagttcg | 36643 |
| hPKU4_R16_P9_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaatacctCggccccttctcagttcgc | 36644 |
| hPKU4_R16_P9_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaataccgCggccccttctcagttcgc | 36645 |
| hPKU4_R16_P9_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaatacctCgccccttctcagttcgc | 36646 |
| hPKU4_R16_P9_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaatacctCgcccattctcagttcgc | 36647 |
| hPKU4_R16_P9_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaataccgCgccccttctcagttcgc | 36648 |
| hPKU4_R16_P9_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCaataccgCgcccattctcagttcgc | 36649 |
| hPKU4_R18_P10_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaatacctCggccccttctcagttcgct | 36650 |
| hPKU4_R18_P10_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaataccgCggccccttctcagttcgct | 36651 |
| hPKU4_R18_P10_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaatacctCgccccttctcagttcgct | 36652 |
| hPKU4_R18_P10_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaatacctCgcccattctcagttcgct | 36653 |
| hPKU4_R18_P10_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaataccgCgccccttctcagttcgct | 36654 |
| hPKU4_R18_P10_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaataccgCgcccattctcagttcgct | 36655 |
| hPKU4_R18_P8_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaatacctCggccccttctcagttcg | 36656 |
| hPKU4_R18_P8_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaataccgCggccccttctcagttcg | 36657 |
| hPKU4_R18_P8_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaatacctCgccccttctcagttcg | 36658 |
| hPKU4_R18_P8_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaatacctCgcccattctcagttcg | 36659 |
| hPKU4_R18_P8_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaataccgCgccccttctcagttcg | 36660 |
| hPKU4_R18_P8_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaataccgCgcccattctcagttcg | 36661 |
| hPKU4_R18_P9_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaatacctCggccccttctcagttcgc | 36662 |
| hPKU4_R18_P9_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaataccgCggccccttctcagttcgc | 36663 |
| hPKU4_R18_P9_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCacaatacctCgccccttctcagttcgc | 36664 |

TABLE 8B-continued

Exemplary template RNA sequences
Table 8B provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU4 spacer GGGTCGTAGCGAACTGAGAA (SEQ ID NO: 16084).

| Name | tgRNA sequence | SEQ ID NO |
|---|---|---|
| hPKU4_R18_ P9_sub5 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCacaatacctCgcccattctcagttcgc | 36665 |
| hPKU4_R18_ P9_sub7 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCacaataccgCgccccttctcagttcgc | 36666 |
| hPKU4_R18_ P9_sub8 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCacaataccgCgcccattctcagttcgc | 36667 |
| hPKU4_R20_ P10_sub0 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaatacctCggcccttctcagttcgct | 36668 |
| hPKU4_R20_ P10_sub1 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaataccgCggcccttctcagttcgct | 36669 |
| hPKU4_R20_ P10_sub4 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaatacctCgccccttctcagttcgct | 36670 |
| hPKU4_R20_ P10_sub5 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaatacctCgcccattctcagttcgct | 36671 |
| hPKU4_R20_ P10_sub7 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaataccgCgccccttctcagttcgct | 36672 |
| hPKU4_R20_ P10_sub8 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaataccgCgcccattctcagttcgct | 36673 |
| hPKU4_R20_ P8_sub0 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaatacctCggcccttctcagttcg | 36674 |
| hPKU4_R20_ P8_sub1 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaataccgCggcccttctcagttcg | 36675 |
| hPKU4_R20_ P8_sub4 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaatacctCgccccttctcagttcg | 36676 |
| hPKU4_R20_ P8_sub5 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaatacctCgcccattctcagttcg | 36677 |
| hPKU4_R20_ P8_sub7 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaataccgCgccccttctcagttcg | 36678 |
| hPKU4_R20_ P8_sub8 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaataccgCgcccattctcagttcg | 36679 |
| hPKU4_R20_ P9_sub0 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaatacctCggcccttctcagttcgc | 36680 |
| hPKU4_R20_ P9_sub1 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaataccgCggcccttctcagttcgc | 36681 |
| hPKU4_R20_ P9_sub4 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaatacctCgccccttctcagttcgc | 36682 |
| hPKU4_R20_ P9_sub5 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaatacctCgcccattctcagttcgc | 36683 |
| hPKU4_R20_ P9_sub7 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaataccgCgccccttctcagttcgc | 36684 |
| hPKU4_R20_ P9_sub8 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCccacaataccgCgcccattctcagttcgc | 36685 |
| hPKU4_R22_ P10_sub0 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCtgccacaatacctCggcccttctcagttcgct | 36686 |
| hPKU4_R22_ P10_sub1 | GGGTCGTAGCGAACTGAGAAGTTTTAGAGCTAGAAATAGCAAGTTAAAATAAGGCTAGTCCGTTATCAACTTGAAAAAGTGGC ACCGAGTCGGTGCtgccacaataccgCggcccttctcagttcgct | 36687 |

TABLE 8B-continued

Exemplary template RNA sequences
Table 8B provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU4 spacer GGGTCGTAGCGAACTGAGAA (SEQ ID NO: 16084).

| Name | tgRNA sequence | SEQ ID NO |
|---|---|---|
| hPKU4_R22_P10_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaatacctCgccccttctcagttcgct | 36688 |
| hPKU4_R22_P10_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaatacctCgcccattctcagttcgct | 36689 |
| hPKU4_R22_P10_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaataccgCgccccttctcagttcgct | 36690 |
| hPKU4_R22_P10_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaataccgCgcccattctcagttcgct | 36691 |
| hPKU4_R22_P8_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaatacctCggcccttctcagttcg | 36692 |
| hPKU4_R22_P8_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaataccgCggcccttctcagttcg | 36693 |
| hPKU4_R22_P8_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaatacctCgccccttctcagttcg | 36694 |
| hPKU4_R22_P8_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaatacctCgcccattctcagttcg | 36695 |
| hPKU4_R22_P8_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaataccgCgccccttctcagttcg | 36696 |
| hPKU4_R22_P8_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaataccgCgcccattctcagttcg | 36697 |
| hPKU4_R22_P9_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaatacctCggcccttctcagttcgc | 36698 |
| hPKU4_R22_P9_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaataccgCggcccttctcagttcgc | 36699 |
| hPKU4_R22_P9_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaatacctCgccccttctcagttcgc | 36700 |
| hPKU4_R22_P9_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaatacctCgcccattctcagttcgc | 36701 |
| hPKU4_R22_P9_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaataccgCgccccttctcagttcgc | 36702 |
| hPKU4_R22_P9_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCtgccacaataccgCgcccattctcagttcgc | 36703 |
| hPKU4_R24_P10_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaatacctCggcccttctcagttcgct | 36704 |
| hPKU4_R24_P10_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaataccgCggcccttctcagttcgct | 36705 |
| hPKU4_R24_P10_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaatacctCgccccttctcagttcgct | 36706 |
| hPKU4_R24_P10_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaatacctCgcccattctcagttcgct | 36707 |
| hPKU4_R24_P10_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaataccgCgccccttctcagttcgct | 36708 |
| hPKU4_R24_P10_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaataccgCgcccattctcagttcgct | 36709 |
| hPKU4_R24_P8_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaatacctCggcccttctcagttcg | 36710 |

TABLE 8B-continued

Exemplary template RNA sequences
Table 8B provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU4 spacer GGGTCGTAGCGAACTGAGAA (SEQ ID NO: 16084).

| Name | tgRNA sequence | SEQ ID NO |
|---|---|---|
| hPKU4_R24_P8_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaataccgCggcccttctcagttcg | 36711 |
| hPKU4_R24_P8_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaatacctCgccccttctcagttcg | 36712 |
| hPKU4_R24_P8_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaatacctCgcccattctcagttcg | 36713 |
| hPKU4_R24_P8_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaataccgCgccccttctcagttcg | 36714 |
| hPKU4_R24_P8_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaataccgCgcccattctcagttcg | 36715 |
| hPKU4_R24_P9_sub0 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaatacctCggcccttctcagttcgc | 36716 |
| hPKU4_R24_P9_sub1 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaataccgCggcccttctcagttcgc | 36717 |
| hPKU4_R24_P9_sub4 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaatacctCgccccttctcagttcgc | 36718 |
| hPKU4_R24_P9_sub5 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaatacctCgcccattctcagttcgc | 36719 |
| hPKU4_R24_P9_sub7 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaataccgCgccccttctcagttcgc | 36720 |
| hPKU4_R24_P9_sub8 | GGGTCGTAGCGAACTGAGAAGTTTTAGAGCTAGAAATAGCAAGTTAAAATAAGGCTAGTCCGTTATCAACTTGAAAAAGTGGCACCGAGTCGGTGCgctgccacaataccgCgcccattctcagttcgc | 36721 |

TABLE 8C

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_P10R10_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaataccgCgccccttctcag | 36722 |
| hPKU5_P10R12_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCacaataccgCgccccttctcag | 36723 |
| hPKU5_P10R14_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCccacaataccgCgccccttctcag | 36724 |
| hPKU5_P10R16_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtgccacaataccgCgccccttctcag | 36725 |
| hPKU5_P10R18_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCgctgccacaataccgCgccccttctcag | 36726 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_ P10R20_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCttgctgccacaataccgCgccccttctcag | 36727 |
| hPKU5_ P10R22_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCctttgctgccacaataccgCgccccttctcag | 36728 |
| hPKU5_ P10R24_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCaactttgctgccacaataccgCgccccttctcag | 36729 |
| hPKU5_ P10R8_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCtaccgCgccccttctcag | 36730 |
| hPKU5_ P11R10_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCaataccgCgccccttctcagt | 36731 |
| hPKU5_ P11R12_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCacaataccgCgccccttctcagt | 36732 |
| hPKU5_ P11R14_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCccacaataccgCgccccttctcagt | 36733 |
| hPKU5_ P11R16_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCtgccacaataccgCgccccttctcagt | 36734 |
| hPKU5_ P11R18_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCgctgccacaataccgCgccccttctcagt | 36735 |
| hPKU5_ P11R20_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCttgctgccacaataccgCgccccttctcagt | 36736 |
| hPKU5_ P11R22_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCctttgctgccacaataccgCgccccttctcagt | 36737 |
| hPKU5_ P11R24_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCaactttgctgccacaataccgCgccccttctcagt | 36738 |
| hPKU5_ P11R8_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCtaccgCgccccttctcagt | 36739 |
| hPKU5_ P12R10_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCaataccgCgccccttctcagtt | 36740 |
| hPKU5_ P12R12_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCacaataccgCgccccttctcagtt | 36741 |
| hPKU5_ P12R14_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCccacaataccgCgccccttctcagtt | 36742 |
| hPKU5_ P12R16_ sub5 | tagcgaactgagaagggccAGTTTTAGAGCTAGAAATAGCAAGTTAAAATAAGGCTAGTCCGTTATCAACTTGAAAAAGTGGCACCGA GTCGGTGCtgccacaataccgCgccccttctcagtt | 36743 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_ P12R18_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCgctgccacaataccgCgccccttctcagtt | 36744 |
| hPKU5_ P12R20_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCttgctgccacaataccgCgccccttctcagtt | 36745 |
| hPKU5_ P12R22_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCctttgctgccacaataccgCgccccttctcagtt | 36746 |
| hPKU5_ P12R24_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaactttgctgccacaataccgCgccccttctcagtt | 36747 |
| hPKU5_ P12R8_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtaccgCgccccttctcagtt | 36748 |
| hPKU5_ P13R10_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaataccgCgccccttctcagttc | 36749 |
| hPKU5_ P13R12_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCacaataccgCgccccttctcagttc | 36750 |
| hPKU5_ P13R14_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCccacaataccgCgccccttctcagttc | 36751 |
| hPKU5_ P13R16_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtgccacaataccgCgccccttctcagttc | 36752 |
| hPKU5_ P13R18_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCgctgccacaataccgCgccccttctcagttc | 36753 |
| hPKU5_ P13R20_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCttgctgccacaataccgCgccccttctcagttc | 36754 |
| hPKU5_ P13R22_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCctttgctgccacaataccgCgccccttctcagttc | 36755 |
| hPKU5_ P13R24_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaactttgctgccacaataccgCgccccttctcagttc | 36756 |
| hPKU5_ P13R8_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtaccgCgccccttctcagttc | 36757 |
| hPKU5_ P14R10_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaataccgCgccccttctcagttcg | 36758 |
| hPKU5_ P14R12_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCacaataccgCgccccttctcagttcg | 36759 |
| hPKU5_ P14R14_ sub5 | tagcgaactgagaagggccAGTTTTAGAGCTAGAAATAGCAAGTTAAAATAAGGCTAGTCCGTTATCAACTTGAAAAAGTGGCACCGAGTCGGTGCccacaataccgCgccccttctcagttcg | 36760 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_P14R16_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtgccacaataccgCgccccttctcagttcg | 36761 |
| hPKU5_P14R18_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCgctgccacaataccgCgccccttctcagttcg | 36762 |
| hPKU5_P14R20_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCttgctgccacaataccgCgccccttctcagttcg | 36763 |
| hPKU5_P14R22_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCctttgctgccacaataccgCgccccttctcagttcg | 36764 |
| hPKU5_P14R24_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaactttgctgccacaataccgCgccccttctcagttcg | 36765 |
| hPKU5_P14R8_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtaccgCgccccttctcagttcg | 36766 |
| hPKU5_P15R10_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaataccgCgccccttctcagttcgc | 36767 |
| hPKU5_P15R12_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCacaataccgCgccccttctcagttcgc | 36768 |
| hPKU5_P15R14_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCccacaataccgCgccccttctcagttcgc | 36769 |
| hPKU5_P15R16_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtgccacaataccgCgccccttctcagttcgc | 36770 |
| hPKU5_P15R18_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCgctgccacaataccgCgccccttctcagttcgc | 36771 |
| hPKU5_P15R20_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCttgctgccacaataccgCgccccttctcagttcgc | 36772 |
| hPKU5_P15R22_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCctttgctgccacaataccgCgccccttctcagttcgc | 36773 |
| hPKU5_P15R24_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaactttgctgccacaataccgCgccccttctcagttcgc | 36774 |
| hPKU5_P15R8_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtaccgCgccccttctcagttcgc | 36775 |
| hPKU5_P16R10_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaataccgCgccccttctcagttcgct | 36776 |
| hPKU5_P16R12_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCacaataccgCgccccttctcagttcgct | 36777 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_P16R14_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCccacaataccgCgccccttctcagttcgct | 36778 |
| hPKU5_P16R16_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtgccacaataccgCgccccttctcagttcgct | 36779 |
| hPKU5_P16R18_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCgctgccacaataccgCgccccttctcagttcgct | 36780 |
| hPKU5_P16R20_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCttgctgccacaataccgCgccccttctcagttcgct | 36781 |
| hPKU5_P16R22_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCctttgctgccacaataccgCgccccttctcagttcgct | 36782 |
| hPKU5_P16R24_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaactttgctgccacaataccgCgccccttctcagttcgct | 36783 |
| hPKU5_P16R8_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtaccgCgccccttctcagttcgct | 36784 |
| hPKU5_P7R10_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaataccgCgccccttct | 36785 |
| hPKU5_P7R12_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCacaataccgCgccccttct | 36786 |
| hPKU5_P7R14_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCccacaataccgCgccccttct | 36787 |
| hPKU5_P7R16_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtgccacaataccgCgccccttct | 36788 |
| hPKU5_P7R18_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCgctgccacaataccgCgccccttct | 36789 |
| hPKU5_P7R20_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCttgctgccacaataccgCgccccttct | 36790 |
| hPKU5_P7R22_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCctttgctgccacaataccgCgccccttct | 36791 |
| hPKU5_P7R24_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaactttgctgccacaataccgCgccccttct | 36792 |
| hPKU5_P7R8_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtaccgCgccccttct | 36793 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_P8R10_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaataccgCgccccttctc | 36794 |
| hPKU5_P8R12_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCacaataccgCgccccttctc | 36795 |
| hPKU5_P8R14_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCccacaataccgCgccccttctc | 36796 |
| hPKU5_P8R16_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtgccacaataccgCgccccttctc | 36797 |
| hPKU5_P8R18_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCgctgccacaataccgCgccccttctc | 36798 |
| hPKU5_P8R20_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCttgctgccacaataccgCgccccttctc | 36799 |
| hPKU5_P8R22_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCctttgctgccacaataccgCgccccttctc | 36800 |
| hPKU5_P8R24_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaactttgctgccacaataccgCgccccttctc | 36801 |
| hPKU5_P8R8_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtaccgCgccccttctc | 36802 |
| hPKU5_P9R10_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaataccgCgccccttctca | 36803 |
| hPKU5_P9R12_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCacaataccgCgccccttctca | 36804 |
| hPKU5_P9R14_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCccacaataccgCgccccttctca | 36805 |
| hPKU5_P9R16_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtgccacaataccgCgccccttctca | 36806 |
| hPKU5_P9R18_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCgctgccacaataccgCgccccttctca | 36807 |
| hPKU5_P9R20_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCttgctgccacaataccgCgccccttctca | 36808 |
| hPKU5_P9R22_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCctttgctgccacaataccgCgccccttctca | 36809 |
| hPKU5_P9R24_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCaactttgctgccacaataccgCgccccttctca | 36810 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_P9R8_sub5 | tagcgaactgagaagggccAGTTTTAGAGCTAGAAATAGCAAGTTAAAATAAGGCTAGTCCGTTATCAACTTGAAAAAGTGGCACCGAGTCGGTGCtaccgCgcccettctca | 36811 |
| hPKU5_R12_P10_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatacctCggcccttctcag | 36812 |
| hPKU5_R12_P10_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaataccgCggcccttctcag | 36813 |
| hPKU5_R12_P10_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatccctCggcccttctcag | 36814 |
| hPKU5_R12_P10_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatcccgCggcccttctcag | 36815 |
| hPKU5_R12_P10_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatacctCgcccettctcag | 36816 |
| hPKU5_R12_P10_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacgatacctCggcccttctcag | 36817 |
| hPKU5_R12_P8_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatacctCggcccttctc | 36818 |
| hPKU5_R12_P8_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaataccgCggcccttctc | 36819 |
| hPKU5_R12_P8_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatccctCggcccttctc | 36820 |
| hPKU5_R12_P8_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatcccgCggcccttctc | 36821 |
| hPKU5_R12_P8_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatacctCgcccettctc | 36822 |
| hPKU5_R12_P8_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacgatacctCggcccttctc | 36823 |
| hPKU5_R12_P9_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatacctCggcccttctca | 36824 |
| hPKU5_R12_P9_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaataccgCggcccttctca | 36825 |
| hPKU5_R12_P9_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatccctCggcccttctca | 36826 |
| hPKU5_R12_P9_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatcccgCggcccttctca | 36827 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_R12_P9_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacaatacctCgccccttctca | 36828 |
| hPKU5_R12_P9_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCacgatacctCggcccttctca | 36829 |
| hPKU5_R14_P10_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatacctCggcccttctcag | 36830 |
| hPKU5_R14_P10_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaataccgCggcccttctcag | 36831 |
| hPKU5_R14_P10_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatccctCggcccttctcag | 36832 |
| hPKU5_R14_P10_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatcccgCggcccttctcag | 36833 |
| hPKU5_R14_P10_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatacctCgccccttctcag | 36834 |
| hPKU5_R14_P10_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacgatacctCggcccttctcag | 36835 |
| hPKU5_R14_P8_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatacctCggcccttctc | 36836 |
| hPKU5_R14P8_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaataccgCggcccttctc | 36837 |
| hPKU5_R14_P8_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatccctCggcccttctc | 36838 |
| hPKU5_R14_P8_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatcccgCggcccttctc | 36839 |
| hPKU5_R14_P8_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatacctCgccccttctc | 36840 |
| hPKU5_R14_P8_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacgatacctCggcccttctc | 36841 |
| hPKU5_R14_P9_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatacctCggcccttctca | 36842 |
| hPKU5_R14_P9_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaataccgCggcccttctca | 36843 |
| hPKU5_R14_P9_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatccctCggcccttctca | 36844 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_R14_P9_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatcccgCggcccttctca | 36845 |
| hPKU5_R14_P9_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacaatacctCgccccttctca | 36846 |
| hPKU5_R14_P9_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCccacgatacctCggcccttctca | 36847 |
| hPKU5_R16_P10_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatacctCggcccttctcag | 36848 |
| hPKU5_R16_P10_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaataccgCggcccttctcag | 36849 |
| hPKU5_R16P_10_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatccctCggcccttctcag | 36850 |
| hPKU5_R16_P10_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatcccgCggcccttctcag | 36851 |
| hPKU5_R16_P10_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatacctCgccccttctcag | 36852 |
| hPKU5_R16_P10_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacgatacctCggcccttctcag | 36853 |
| hPKU5_R16_P8_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatacctCggcccttctc | 36854 |
| hPKU5_R16_P8_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaataccgCggcccttctc | 36855 |
| hPKU5_R16_P8_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatccctCggcccttctc | 36856 |
| hPKU5_R16_P8_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatcccgCggcccttctc | 36857 |
| hPKU5_R16_P8_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatacctCgccccttctc | 36858 |
| hPKU5_R16_P8_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacgatacctCggcccttctc | 36859 |
| hPKU5_R16_P9_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatacctCggcccttctca | 36860 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_R16_P9_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaataccgCggcccttctca | 36861 |
| hPKU5_R16_P9_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatccctCggcccttctca | 36862 |
| hPKU5_R16_P9_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatcccgCggcccttctca | 36863 |
| hPKU5_R16_P9_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacaatacctCgccccttctca | 36864 |
| hPKU5_R16_P9_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCtgccacgatacctCggcccttctca | 36865 |
| hPKU5_R18_P10_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaatacctCggcccttctcag | 36866 |
| hPKU5_R18_P10_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaataccgCggcccttctcag | 36867 |
| hPKU5_R18_P10_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaatccctCggcccttctcag | 36868 |
| hPKU5_R18_P10_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaatcccgCggcccttctcag | 36869 |
| hPKU5_R18_P10_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaatacctCgccccttctcag | 36870 |
| hPKU5_R18_P10_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacgatacctCggcccttctcag | 36871 |
| hPKU5_R18_P8_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaatacctCggcccttctc | 36872 |
| hPKU5_R18_P8_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaataccgCggcccttctc | 36873 |
| hPKU5_R18_P8_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaatccctCggcccttctc | 36874 |
| hPKU5_R18_P8_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaatcccgCggcccttctc | 36875 |
| hPKU5_R18_P8_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCgctgccacaatacctCgccccttctc | 36876 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_ R18_P8_ sub7 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCgctgccacgatacctCggcccttctc | 36877 |
| hPKU5_ R18_P9_ sub0 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCgctgccacaatacctCggcccttctca | 36878 |
| hPKU5_ R18_P9_ sub1 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCgctgccacaataccgCggcccttctca | 36879 |
| hPKU5_ R18_P9_ sub2 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCgctgccacaatccctCggcccttctca | 36880 |
| hPKU5_ R18_P9_ sub3 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCgctgccacaatcccgCggcccttctca | 36881 |
| hPKU5_ R18_P9_ sub4 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCgctgccacaatacctCgcccccttctca | 36882 |
| hPKU5_ R18_P9_ sub7 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCgctgccacgatacctCggcccttctca | 36883 |
| hPKU5_ R20_P10_ sub0 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacaatacctCggcccttctcag | 36884 |
| hPKU5_ R20_P10_ sub1 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacaataccgCggcccttctcag | 36885 |
| hPKU5_ R20_P10_ sub2 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacaatccctCggcccttctcag | 36886 |
| hPKU5_ R20_P10_ sub3 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacaatcccgCggcccttctcag | 36887 |
| hPKU5_ R20_P10_ sub4 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacaatacctCgcccccttctcag | 36888 |
| hPKU5_ R20_P10_ sub7 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacgatacctCggcccttctcag | 36889 |
| hPKU5_ R20_P8_ sub0 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacaatacctCggcccttctc | 36890 |
| hPKU5_ R20_P8_ sub1 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacaataccgCggcccttctc | 36891 |
| hPKU5_ R20_P8_ sub2 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacaatccctCggcccttctc | 36892 |
| hPKU5_ R20_P8_ sub3 | TAGCGAACTGAGAAGGGCCAGTTTTAGAGCTAGAAATAGCAAGTTAAAATAAGGCTAGTCCGTTATCAACTTGAAAAAGTGGC ACCGAGTCGGTGCttgctgccacaatcccgCggcccttctc | 36893 |

TABLE 8C-continued

Exemplary template RNA sequences
Table 8C provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU5 spacer TAGCGAACTGAGAAGGGCCA (SEQ ID NO: 16011).

| Name | tgRNA sequence | SEQ ID NO |
|---|---|---|
| hPKU5_R20_P8_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCttgctgccacaatacctCgcccccttctc | 36894 |
| hPKU5_R20_P8_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCttgctgccacgatacctCggcccttctc | 36895 |
| hPKU5_R20_P9_sub0 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCttgctgccacaatacctCggcccttctca | 36896 |
| hPKU5_R20_P9_sub1 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCttgctgccacaataccgCggcccttctca | 36897 |
| hPKU5_R20_P9_sub2 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCttgctgccacaatccctCggcccttctca | 36898 |
| hPKU5_R20_P9_sub3 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCttgctgccacaatcccgCggcccttctca | 36899 |
| hPKU5_R20_P9_sub4 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCttgctgccacaatacctCgcccccttctca | 36900 |
| hPKU5_R20_P9_sub7 | TAGCGAACTGAGAAGGGCCAGTTTTAGAGCTAGAAATAGCAAGTTAAAATAAGGCTAGTCCGTTATCAACTTGAAAAAGTGGCACCGAGTCGGTGCttgctgccacgatacctCggcccttctca | 36901 |

TABLE 8D

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_P10R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtggca | 36902 |
| hPKU6_P10R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtggca | 36903 |
| hPKU6_P10R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtggca | 36904 |
| hPKU6_P10R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtggca | 36905 |
| hPKU6_P10R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtggca | 36906 |
| hPKU6_P10R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtggca | 36907 |
| hPKU6_P10R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtggca | 36908 |
| hPKU6_P10R25_sub3 | actttgctgccacaatacctGTTTTAGAGCTAGAAATAGCAAGTTAAAATAAGGCTAGTCCGTTATCAACTTGAAAAAGTGGCACCGAGTCGGTGCcgtagcgaactgagaagggacGgggtattgtggca | 36909 |
| hPKU6_P10R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtggca | 36910 |
| hPKU6_P11R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtggcag | 36911 |
| hPKU6_P11R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtggcag | 36912 |
| hPKU6_P11R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtggcag | 36913 |
| hPKU6_P11R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtggcag | 36914 |
| hPKU6_P11R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtggcag | 36915 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_P11R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtggcag | 36916 |
| hPKU6_P11R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtggcag | 36917 |
| hPKU6_P11R25_sub3 | actttgctgccacaatacctGTTTTAGAGCTAGAAATAGCAAGTTAAAATAAGGCTAGTCCGTTATCAACTTGAAAAAGTGGCACCGAGTCGGTGCcgtagcgaactgagaagggacGgggtattgtggcag | 36918 |
| hPKU6_P11R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtggcag | 36919 |
| hPKU6_P12R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtggcagc | 36920 |
| hPKU6_P12R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtggcagc | 36921 |
| hPKU6_P12R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtggcagc | 36922 |
| hPKU6_P12R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtggcagc | 36923 |
| hPKU6_P12R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtggcagc | 36924 |
| hPKU6_P12R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtggcagc | 36925 |
| hPKU6_P12R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtggcagc | 36926 |
| hPKU6_P12R25_sub3 | actttgctgccacaatacctGTTTTAGAGCTAGAAATAGCAAGTTAAAATAAGGCTAGTCCGTTATCAACTTGAAAAAGTGGCACCGAGTCGGTGCcgtagcgaactgagaagggacGgggtattgtggcagc | 36927 |
| hPKU6_P12R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtggcagc | 36928 |
| hPKU6_P13R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtggcagca | 36929 |
| hPKU6_P13R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtggcagca | 36930 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_P13R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtggcagca | 36931 |
| hPKU6_P13R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtggcagca | 36932 |
| hPKU6_P13R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtggcagca | 36933 |
| hPKU6_P13R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtggcagca | 36934 |
| hPKU6_P13R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtggcagca | 36935 |
| hPKU6_P13R25_sub3 | actttgctgccacaatacctGTTTTAGAGCTAGAAATAGCAAGTTAAAATAAGGCTAGTCCGTTATCAACTTGAAAAAGTGGCACCGAGTCGGTGCcgtagcgaactgagaagggacGgggtattgtggcagca | 36936 |
| hPKU6_P13R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtggcagca | 36937 |
| hPKU6_P14R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtggcagcaa | 36938 |
| hPKU6_P14R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtggcagcaa | 36939 |
| hPKU6_P14R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtggcagcaa | 36940 |
| hPKU6_P14R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtggcagcaa | 36941 |
| hPKU6_P14R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtggcagcaa | 36942 |
| hPKU6_P14R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtggcagcaa | 36943 |
| hPKU6_P14R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtggcagcaa | 36944 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_P14R25_sub3 | actttgctgccacaatacctGTTTTAGAGCTAGAAATAGCAAGTTAAAATAAGGCTAGTCCGTTATCAACTTGAAAAAGTGGCACCGAGTCGGTGCcgtagcgaactgagaagggacGgggtattgtggcagcaa | 36945 |
| hPKU6_P14R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtggcagcaa | 36946 |
| hPKU6_P15R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtggcagcaaa | 36947 |
| hPKU6_P15R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtggcagcaaa | 36948 |
| hPKU6_P15R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtggcagcaaa | 36949 |
| hPKU6_P15R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtggcagcaaa | 36950 |
| hPKU6_P15R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtggcagcaaa | 36951 |
| hPKU6_P15R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtggcagcaaa | 36952 |
| hPKU6_P15R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtggcagcaaa | 36953 |
| hPKU6_P15R25_sub3 | actttgctgccacaatacctGTTTTAGAGCTAGAAATAGCAAGTTAAAATAAGGCTAGTCCGTTATCAACTTGAAAAAGTGGCACCGAGTCGGTGCcgtagcgaactgagaagggacGgggtattgtggcagcaaa | 36954 |
| hPKU6_P15R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtggcagcaaa | 36955 |
| hPKU6_P16R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtggcagcaaag | 36956 |
| hPKU6_P16R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtggcagcaaag | 36957 |
| hPKU6_P16R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtggcagcaaag | 36958 |
| hPKU6_P16R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtggcagcaaag | 36959 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_P16R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtggcagcaaag | 36960 |
| hPKU6_P16R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtggcagcaaag | 36961 |
| hPKU6_P16R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtggcagcaaag | 36962 |
| hPKU6_P16R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtggcagcaaag | 36963 |
| hPKU6_P16R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtggcagcaaag | 36964 |
| hPKU6_P7R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtg | 36965 |
| hPKU6_P7R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtg | 36966 |
| hPKU6_P7R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtg | 36967 |
| hPKU6_P7R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtg | 36968 |
| hPKU6_P7R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtg | 36969 |
| hPKU6_P7R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtg | 36970 |
| hPKU6_P7R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtg | 36971 |
| hPKU6_P7R25_sub3 | actttgctgccacaatacctGTTTTAGAGCTAGAAATAGCAAGTTAAAATAAGGCTAGTCCGTTATCAACTTGAAAAAGTGGCACCGAGTCGGTGCcgtagcgaactgagaagggacGgggtattgtg | 36972 |
| hPKU6_P7R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtg | 36973 |
| hPKU6_P8R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtgg | 36974 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_P8R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtgg | 36975 |
| hPKU6_P8R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtgg | 36976 |
| hPKU6_P8R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtgg | 36977 |
| hPKU6_P8R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtgg | 36978 |
| hPKU6_P8R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtgg | 36979 |
| hPKU6_P8R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtgg | 36980 |
| hPKU6_P8R25_sub3 | actttgctgccacaatacctGTTTTAGAGCTAGAAATAGCAAGTTAAAATAAGGCTAGTCCGTTATCAACTTGAAAAAGTGGCACCGAGTCGGTGCcgtagcgaactgagaagggacGgggtattgtgg | 36981 |
| hPKU6_P8R9_sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtgg | 36982 |
| hPKU6_P9R11_sub3 | actttgctgccacaatacctGTTTTAGAGCTAGAAATAGCAAGTTAAAATAAGGCTAGTCCGTTATCAACTTGAAAAAGTGGCACCGAGTCGGTGCaagggacGgggtattgtggc | 36983 |
| hPKU6_P9R13_sub3 | actttgctgccacaatacctGTTTTAGAGCTAGAAATAGCAAGTTAAAATAAGGCTAGTCCGTTATCAACTTGAAAAAGTGGCACCGAGTCGGTGCagaagggacGgggtattgtggc | 36984 |
| hPKU6_P9R15_sub3 | actttgctgccacaatacctGTTTTAGAGCTAGAAATAGCAAGTTAAAATAAGGCTAGTCCGTTATCAACTTGAAAAAGTGGCACCGAGTCGGTGCtgagaagggacGgggtattgtggc | 36985 |
| hPKU6_P9R17_sub3 | actttgctgccacaatacctGTTTTAGAGCTAGAAATAGCAAGTTAAAATAAGGCTAGTCCGTTATCAACTTGAAAAAGTGGCACCGAGTCGGTGCactgagaagggacGgggtattgtggc | 36986 |
| hPKU6_P9R19_sub3 | actttgctgccacaatacctGTTTTAGAGCTAGAAATAGCAAGTTAAAATAAGGCTAGTCCGTTATCAACTTGAAAAAGTGGCACCGAGTCGGTGCgaactgagaagggacGgggtattgtggc | 36987 |
| hPKU6_P9R21_sub3 | actttgctgccacaatacctGTTTTAGAGCTAGAAATAGCAAGTTAAAATAAGGCTAGTCCGTTATCAACTTGAAAAAGTGGCACCGAGTCGGTGCgcgaactgagaagggacGgggtattgtggc | 36988 |
| hPKU6_P9R23_sub3 | actttgctgccacaatacctGTTTTAGAGCTAGAAATAGCAAGTTAAAATAAGGCTAGTCCGTTATCAACTTGAAAAAGTGGCACCGAGTCGGTGCtagcgaactgagaagggacGgggtattgtggc | 36989 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_P9R25_sub3 | actttgctgccacaatacctGTTTTAGAGCTAGAAATAGCAAGTTAAAATAAGGCTAGTCCGTTATCAACTTGAAAAAGTGGCACCGAGTCGGTGCcgtagcgaactgagaagggacGgggtattgtggc | 36990 |
| hPKU6_P9R9__sub3 | actttgctgccacaatacctGTTTTAGAGCTAGAAATAGCAAGTTAAAATAAGGCTAGTCCGTTATCAACTTGAAAAAGTGGCACCGAGTCGGTGCgggacGgggtattgtggc | 36991 |
| hPKU6_R12_P10_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggccGaggtattgtggca | 36992 |
| hPKU6_R12_P10_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggccGgggtattgtggca | 36993 |
| hPKU6_R12_P10_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaacggccGgggtattgtggca | 36994 |
| hPKU6_R12_P10_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaacggacGgggtattgtggca | 36995 |
| hPKU6_R12_P10_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggccGcggtattgtggca | 36996 |
| hPKU6_R12_P10_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggacGcggtattgtggca | 36997 |
| hPKU6_R12_P11_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggccGaggtattgtggcag | 36998 |
| hPKU6_R12_P11_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggccGgggtattgtggcag | 36999 |
| hPKU6_R12_P11_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaacggccGgggtattgtggcag | 37000 |
| hPKU6_R12_P11_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaacggacGgggtattgtggcag | 37001 |
| hPKU6_R12_P11_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggccGcggtattgtggcag | 37002 |
| hPKU6_R12_P11_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggacGcggtattgtggcag | 37003 |
| hPKU6_R12_P9_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggccGaggtattgtggc | 37004 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_R12_P9_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggccGgggtattgtggc | 37005 |
| hPKU6_R12_P9_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaacggccGgggtattgtggc | 37006 |
| hPKU6_R12_P9_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaacggacGgggtattgtggc | 37007 |
| hPKU6_R12_P9_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggccGcggtattgtggc | 37008 |
| hPKU6_R12_P9_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgaagggacGcggtattgtggc | 37009 |
| hPKU6_R14_P10_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggccGaggtattgtggca | 37010 |
| hPKU6_R14_P10_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggccGgggtattgtggca | 37011 |
| hPKU6_R14_P10_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaacggccGgggtattgtggca | 37012 |
| hPKU6_R14_P10_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaacggacGgggtattgtggca | 37013 |
| hPKU6_R14_P10_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggccGcggtattgtggca | 37014 |
| hPKU6_R14_P10_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggacGcggtattgtggca | 37015 |
| hPKU6_R14_P11 sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggccGaggtattgtggcag | 37016 |
| hPKU6_R14_P11_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggccGgggtattgtggcag | 37017 |
| hPKU6_R14_P11 sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaacggccGgggtattgtggcag | 37018 |
| hPKU6_R14_P11_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaacggacGgggtattgtggcag | 37019 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_R14_P11_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggccGcggtattgtggcag | 37020 |
| hPKU6_R14_P11 sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggacGcggtattgtggcag | 37021 |
| hPKU6_R14_P9_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggccGaggtattgtggc | 37022 |
| hPKU6_R14_P9_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggccGgggtattgtggc | 37023 |
| hPKU6_R14_P9_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaacggccGgggtattgtggc | 37024 |
| hPKU6_R14_P9_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaacggacGgggtattgtggc | 37025 |
| hPKU6_R14_P9_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggccGcggtattgtggc | 37026 |
| hPKU6_R14_P9_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCgagaagggacGcggtattgtggc | 37027 |
| hPKU6_R16_P10_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggccGaggtattgtggca | 37028 |
| hPKU6_R16_P10_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggccGgggtattgtggca | 37029 |
| hPKU6_R16_P10_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaacggccGgggtattgtggca | 37030 |
| hPKU6_R16_P10_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaacggacGgggtattgtggca | 37031 |
| hPKU6_R16_P10_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggccGcggtattgtggca | 37032 |
| hPKU6_R16_P10_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggacGcggtattgtggca | 37033 |
| hPKU6_R16_P11_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggccGaggtattgtggcag | 37034 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_R16_P11_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggccGgggtattgtggcag | 37035 |
| hPKU6_R16_P11_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaacggccGgggtattgtggcag | 37036 |
| hPKU6_R16_P11_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaacggacGgggtattgtggcag | 37037 |
| hPKU6_R16_P11_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggccGcggtattgtggcag | 37038 |
| hPKU6_R16_P11_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggacGcggtattgtggcag | 37039 |
| hPKU6_R16_P9_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggccGaggtattgtggc | 37040 |
| hPKU6_R16_P9_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggccGgggtattgtggc | 37041 |
| hPKU6_R16_P9_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaacggccGgggtattgtggc | 37042 |
| hPKU6_R16_P9_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaacggacGgggtattgtggc | 37043 |
| hPKU6_R16_P9_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggccGcggtattgtggc | 37044 |
| hPKU6_R16_P9_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCctgagaagggacGcggtattgtggc | 37045 |
| hPKU6_R18_P10_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggccGaggtattgtggca | 37046 |
| hPKU6_R18_P10_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggccGgggtattgtggca | 37047 |
| hPKU6_R18_P10_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaacggccGgggtattgtggca | 37048 |
| hPKU6_R18_P10_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaacggacGgggtattgtggca | 37049 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_R18_P10_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggccGcggtattgtggca | 37050 |
| hPKU6_R18_P10_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggacGcggtattgtggca | 37051 |
| hPKU6_R18_P11 sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggccGaggtattgtggcag | 37052 |
| hPKU6_R18_P11_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggccGgggtattgtggcag | 37053 |
| hPKU6_R18_P11_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaacggccGgggtattgtggcag | 37054 |
| hPKU6_R18_P11_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaacggacGgggtattgtggcag | 37055 |
| hPKU6_R18_P11_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggccGcggtattgtggcag | 37056 |
| hPKU6_R18_P11_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggacGcggtattgtggcag | 37057 |
| hPKU6_R18_P9_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggccGaggtattgtggc | 37058 |
| hPKU6_R18_P9_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggccGgggtattgtggc | 37059 |
| hPKU6_R18_P9_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaacggccGgggtattgtggc | 37060 |
| hPKU6_R18_P9_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaacggacGgggtattgtggc | 37061 |
| hPKU6_R18_P9_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggccGcggtattgtggc | 37062 |
| hPKU6_R18_P9_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCaactgagaagggacGcggtattgtggc | 37063 |
| hPKU6_R20_P10_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggccGaggtattgtggca | 37064 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_R20_P10_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggccGggtattgtggca | 37065 |
| hPKU6_R20_P10_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaacggccGggtattgtggca | 37066 |
| hPKU6_R20_P10_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaacggacGggtattgtggca | 37067 |
| hPKU6_R20_P10_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggccGcggtattgtggca | 37068 |
| hPKU6_R20_P10_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggacGcggtattgtggca | 37069 |
| hPKU6_R20_P11_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggccGaggtattgtggcag | 37070 |
| hPKU6_R20_P11_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggccGggtattgtggcag | 37071 |
| hPKU6_R20_P11 sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaacggccGggtattgtggcag | 37072 |
| hPKU6_R20_P11_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaacggacGggtattgtggcag | 37073 |
| hPKU6_R20_P11_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggccGcggtattgtggcag | 37074 |
| hPKU6_R20_P11_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggacGcggtattgtggcag | 37075 |
| hPKU6_R20_P9_sub0 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggccGaggtattgtggc | 37076 |
| hPKU6_R20_P9_sub1 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggccGggtattgtggc | 37077 |
| hPKU6_R20_P9_sub4 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaacggccGggtattgtggc | 37078 |
| hPKU6_R20_P9_sub5 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaacggacGggtattgtggc | 37079 |

TABLE 8D-continued

Exemplary template RNA sequences
Table 8D provides design of exemplary DNA components of gene modifying systems for correcting the pathogenic R408W mutation in PAH to the wild-type form. This table details the sequence of a complete template RNA comprising one or more silent substitutions described in Table 7A for use in a Cas-RT fusion gene modifying polypeptide. Templates in this table employ the hPKU6 spacer ACTTTGCTGCCACAATACCT (SEQ ID NO: 16032).

| Name | tgRNA sequence | SEQ ID NO |
|---|---|---|
| hPKU6_R20_P9_sub6 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggccGcggtattgtggc | 37080 |
| hPKU6_R20_P9_sub7 | ACTTTGCTGCCACAATACCTGTTTTAGAGCTAGAAATAGCAAGTTAAAATAAGGCTAGTCCGTTATCAACTTGAAAAAGTGGCACCGAGTCGGTGCcgaactgagaagggacGcggtattgtggc | 37081 |

gRNAs with Inducible Activity

In some embodiments, a gRNA described herein (e.g., a gRNA that is part of a template RNA or a gRNA used for second strand nicking) has inducible activity. Inducible activity may be achieved by the template nucleic acid, e.g., template RNA, further comprising (in addition to the gRNA) a blocking domain, wherein the sequence of a portion of or all of the blocking domain is at least partially complementary to a portion or all of the gRNA. The blocking domain is thus capable of hybridizing or substantially hybridizing to a portion of or all of the gRNA. In some embodiments, the blocking domain and inducibly active gRNA are disposed on the template nucleic acid, e.g., template RNA, such that the gRNA can adopt a first conformation where the blocking domain is hybridized or substantially hybridized to the gRNA, and a second conformation where the blocking domain is not hybridized or not substantially hybridized to the gRNA. In some embodiments, in the first conformation the gRNA is unable to bind to the gene modifying polypeptide (e.g., the template nucleic acid binding domain, DNA binding domain, or endonuclease domain (e.g., a CRISPR/Cas protein)) or binds with substantially decreased affinity compared to an otherwise similar template RNA lacking the blocking domain. In some embodiments, in the second conformation the gRNA is able to bind to the gene modifying polypeptide (e.g., the template nucleic acid binding domain, DNA binding domain, or endonuclease domain (e.g., a CRISPR/Cas protein)). In some embodiments, whether the gRNA is in the first or second conformation can influence whether the DNA binding or endonuclease activities of the gene modifying polypeptide (e.g., of the CRISPR/Cas protein the gene modifying polypeptide comprises) are active.

In some embodiments, the gRNA that coordinates the second nick has inducible activity. In some embodiments, the gRNA that coordinates the second nick is induced after the template is reverse transcribed. In some embodiments, hybridization of the gRNA to the blocking domain can be disrupted using an opener molecule. In some embodiments, an opener molecule comprises an agent that binds to a portion or all of the gRNA or blocking domain and inhibits hybridization of the gRNA to the blocking domain. In some embodiments, the opener molecule comprises a nucleic acid, e.g., comprising a sequence that is partially or wholly complementary to the gRNA, blocking domain, or both. By choosing or designing an appropriate opener molecule, providing the opener molecule can promote a change in the conformation of the gRNA such that it can associate with a CRISPR/Cas protein and provide the associated functions of the CRISPR/Cas protein (e.g., DNA binding and/or endonuclease activity). Without wishing to be bound by theory, providing the opener molecule at a selected time and/or location may allow for spatial and temporal control of the activity of the gRNA, CRISPR/Cas protein, or gene modifying system comprising the same. In some embodiments, the opener molecule is exogenous to the cell comprising the gene modifying polypeptide and or template nucleic acid. In some embodiments, the opener molecule comprises an endogenous agent (e.g., endogenous to the cell comprising the gene modifying polypeptide and or template nucleic acid comprising the gRNA and blocking domain). For example, an inducible gRNA, blocking domain, and opener molecule may be chosen such that the opener molecule is an endogenous agent expressed in a target cell or tissue, e.g., thereby ensuring activity of a gene modifying system in the target cell or tissue. As a further example, an inducible gRNA, blocking domain, and opener molecule may be chosen such that the opener molecule is absent or not substantially expressed in one or more non-target cells or tissues, e.g., thereby ensuring that activity of a gene modifying system does not occur or substantially occur in the one or more non-target cells or tissues, or occurs at a reduced level compared to a target cell or tissue. Exemplary blocking domains, opener molecules, and uses thereof are described in PCT App. Publication WO2020044039A1, which is incorporated herein by reference in its entirety. In some embodiments, the template nucleic acid, e.g., template RNA, may comprise one or more sequences or structures for binding by one or more components of a gene modifying polypeptide, e.g., by a reverse transcriptase or RNA binding domain, and a gRNA. In some embodiments, the gRNA facilitates interaction with the template nucleic acid binding domain (e.g., RNA binding domain) of the gene modifying polypeptide. In some embodiments, the gRNA directs the gene modifying polypeptide to the matching target sequence, e.g., in a target cell genome.

Circular RNAs and Ribozymes in Gene Modifying Systems

It is contemplated that it may be useful to employ circular and/or linear RNA states during the formulation, delivery, or gene modifying reaction within the target cell. Thus, in some embodiments of any of the aspects described herein, a gene modifying system comprises one or more circular RNAs (circRNAs). In some embodiments of any of the aspects described herein, a gene modifying system comprises one or more linear RNAs. In some embodiments, a nucleic acid as described herein (e.g., a template nucleic acid, a nucleic acid molecule encoding a gene modifying polypeptide, or both) is a circRNA. In some embodiments, a circular RNA molecule encodes the gene modifying polypeptide. In some embodiments, the circRNA molecule encoding the gene modifying polypeptide is delivered to a host cell. In some embodiments, a circular RNA molecule encodes a recombinase, e.g., as described herein. In some embodiments, the circRNA molecule encoding the recombinase is delivered to a host cell. In some embodiments, the circRNA molecule encoding the gene modifying polypeptide is linearized (e.g., in the host cell, e.g., in the nucleus of the host cell) prior to translation.

Circular RNAs (circRNAs) have been found to occur naturally in cells and have been found to have diverse functions, including both non-coding and protein coding roles in human cells. It has been shown that a circRNA can be engineered by incorporating a self-splicing intron into an RNA molecule (or DNA encoding the RNA molecule) that results in circularization of the RNA, and that an engineered circRNA can have enhanced protein production and stability (Wesselhoeft et al. *Nature Communications* 2018). In some embodiments, the gene modifying polypeptide is encoded as circRNA. In certain embodiments, the template nucleic acid is a DNA, such as a dsDNA or ssDNA. In certain embodiments, the circDNA comprises a template RNA.

In some embodiments, the circRNA comprises one or more ribozyme sequences. In some embodiments, the ribozyme sequence is activated for autocleavage, e.g., in a host cell, e.g., thereby resulting in linearization of the circRNA. In some embodiments, the ribozyme is activated when the concentration of magnesium reaches a sufficient level for cleavage, e.g., in a host cell. In some embodiments the circRNA is maintained in a low magnesium environment prior to delivery to the host cell. In some embodiments, the ribozyme is a protein-responsive ribozyme. In some embodiments, the ribozyme is a nucleic acid-responsive ribozyme. In some embodiments, the circRNA comprises a cleavage site. In some embodiments, the circRNA comprises a second cleavage site.

In some embodiments, the circRNA is linearized in the nucleus of a target cell. In some embodiments, linearization of a circRNA in the nucleus of a cell involves components present in the nucleus of the cell, e.g., to activate a cleavage event. In some embodiments, a ribozyme, e.g., a ribozyme from a B2 or ALU element, that is responsive to a nuclear element, e.g., a nuclear protein, e.g., a genome-interacting protein, e.g., an epigenetic modifier, e.g., EZH2, is incorporated into a circRNA, e.g., of a gene modifying system. In some embodiments, nuclear localization of the circRNA results in an increase in autocatalytic activity of the ribozyme and linearization of the circRNA.

In some embodiments, the ribozyme is heterologous to one or more of the other components of the gene modifying system. In some embodiments, an inducible ribozyme (e.g., in a circRNA as described herein) is created synthetically, for example, by utilizing a protein ligand-responsive aptamer design. A system for utilizing the satellite RNA of tobacco ringspot virus hammerhead ribozyme with an MS2 coat protein aptamer has been described (Kennedy et al. Nucleic Acids Res 42(19):12306-12321 (2014), incorporated herein by reference in its entirety) that results in activation of the ribozyme activity in the presence of the MS2 coat protein. In embodiments, such a system responds to protein ligand localized to the cytoplasm or the nucleus. In some embodiments the protein ligand is not MS2. Methods for generating RNA aptamers to target ligands have been described, for example, based on the systematic evolution of ligands by exponential enrichment (SELEX) (Tuerk and Gold, Science 249(4968):505-510 (1990); Ellington and Szostak, Nature 346(6287):818-822 (1990); the methods of each of which are incorporated herein by reference) and have, in some instances, been aided by in silico design (Bell et al. PNAS 117(15):8486-8493, the methods of which are incorporated herein by reference). Thus, in some embodiments, an aptamer for a target ligand is generated and incorporated into a synthetic ribozyme system, e.g., to trigger ribozyme-mediated cleavage and circRNA linearization, e.g., in the presence of the protein ligand. In some embodiments, circRNA linearization is triggered in the cytoplasm, e.g., using an aptamer that associates with a ligand in the cytoplasm. In some embodiments, circRNA linearization is triggered in the nucleus, e.g., using an aptamer that associates with a ligand in the nucleus. In embodiments, the ligand in the nucleus comprises an epigenetic modifier or a transcription factor. In some embodiments the ligand that triggers linearization is present at higher levels in on-target cells than off-target cells.

It is further contemplated that a nucleic acid-responsive ribozyme system can be employed for circRNA linearization. For example, biosensors that sense defined target nucleic acid molecules to trigger ribozyme activation are described, e.g., in Penchovsky (Biotechnology Advances 32(5):1015-1027 (2014), incorporated herein by reference). By these methods, a ribozyme naturally folds into an inactive state and is only activated in the presence of a defined target nucleic acid molecule (e.g., an RNA molecule). In some embodiments, a circRNA of a gene modifying system comprises a nucleic acid-responsive ribozyme that is activated in the presence of a defined target nucleic acid, e.g., an RNA, e.g., an mRNA, miRNA, guide RNA, gRNA, sgRNA, ncRNA, lncRNA, tRNA, snRNA, or mtRNA. In some embodiments the nucleic acid that triggers linearization is present at higher levels in on-target cells than off-target cells.

In some embodiments of any of the aspects herein, a gene modifying system incorporates one or more ribozymes with inducible specificity to a target tissue or target cell of interest, e.g., a ribozyme that is activated by a ligand or nucleic acid present at higher levels in a target tissue or target cell of interest. In some embodiments, the gene modifying system incorporates a ribozyme with inducible specificity to a subcellular compartment, e.g., the nucleus, nucleolus, cytoplasm, or mitochondria. In some embodiments, the ribozyme that is activated by a ligand or nucleic acid present at higher levels in the target subcellular compartment. In some embodiments, an RNA component of a gene modifying system is provided as circRNA, e.g., that is activated by linearization. In some embodiments, linearization of a circRNA encoding a gene modifying polypeptide activates the molecule for translation. In some embodiments, a signal that activates a circRNA component of a gene modifying system is present at higher levels in on-target cells or tissues, e.g., such that the system is specifically activated in these cells.

In some embodiments, an RNA component of a gene modifying system is provided as a circRNA that is inactivated by linearization. In some embodiments, a circRNA encoding the gene modifying polypeptide is inactivated by cleavage and degradation. In some embodiments, a circRNA encoding the gene modifying polypeptide is inactivated by cleavage that separates a translation signal from the coding sequence of the polypeptide. In some embodiments, a signal that inactivates a circRNA component of a gene modifying system is present at higher levels in off-target cells or tissues, such that the system is specifically inactivated in these cells.

Target Nucleic Acid Site

In some embodiments, after gene modification, the target site surrounding the edited sequence contains a limited number of insertions or deletions, for example, in less than about 50% or 10% of editing events, e.g., as determined by long-read amplicon sequencing of the target site, e.g., as described in Karst et al. (2020) *bioRxiv* doi.org/10.1101/645903 (incorporated by reference herein in its entirety). In some embodiments, the target site does not show multiple consecutive editing events, e.g., head-to-tail or head-to-head duplications, e.g., as determined by long-read amplicon sequencing of the target site, e.g., as described in Karst et al. *bioRxiv* doi.org/10.1101/645903 (2020) (incorporated herein by reference in its entirety). In some embodiments, the target site contains an integrated sequence corresponding to the template RNA. In some embodiments, the target site does not contain insertions resulting from endogenous RNA in more than about 1% or 10% of events, e.g., as determined by long-read amplicon sequencing of the target site, e.g., as described in Karst et al. *bioRxiv* doi.org/10.1101/645903 (2020) (incorporated herein by reference in its entirety). In some embodiments, the target site contains the integrated sequence corresponding to the template RNA.

In certain aspects of the present invention, the host DNA-binding site integrated into by the gene modifying system can be in a gene, in an intron, in an exon, an ORF, outside of a coding region of any gene, in a regulatory region of a gene, or outside of a regulatory region of a gene. In other aspects, the polypeptide may bind to one or more than one host DNA sequence.

In some embodiments, a gene modifying system is used to edit a target locus in multiple alleles. In some embodiments, a gene modifying system is designed to edit a specific allele. For example, a gene modifying polypeptide may be directed to a specific sequence that is only present on one allele, e.g., comprises a template RNA with homology to a target allele, e.g., a gRNA or annealing domain, but not to a second cognate allele. In some embodiments, a gene modifying system can alter a haplotype-specific allele. In some embodiments, a gene modifying system that targets a specific allele preferentially targets that allele, e.g., has at least a 2, 4, 6, 8, or 10-fold preference for a target allele.

Second Strand Nicking

In some embodiments, a gene modifying system described herein comprises a nickase activity (e.g., in the gene modifying polypeptide) that nicks the first strand, and a nickase activity (e.g., in a polypeptide separate from the gene modifying polypeptide) that nicks the second strand of target DNA. As discussed herein, without wishing to be bound by theory, nicking of the first strand of the target site DNA is thought to provide a 3' OH that can be used by an RT domain to reverse transcribe a sequence of a template RNA, e.g., a heterologous object sequence. Without wishing to be bound by theory, it is thought that introducing an additional nick to the second strand may bias the cellular DNA repair machinery to adopt the heterologous object sequence-based sequence more frequently than the original genomic sequence. In some embodiments, the additional nick to the second strand is made by the same endonuclease domain (e.g., nickase domain) as the nick to the first strand. In some embodiments, the same gene modifying polypeptide performs both the nick to the first strand and the nick to the second strand. In some embodiments, the gene modifying polypeptide comprises a CRISPR/Cas domain and the additional nick to the second strand is directed by an additional nucleic acid, e.g., comprising a second gRNA directing the CRISPR/Cas domain to nick the second strand. In other embodiments, the additional second strand nick is made by a different endonuclease domain (e.g., nickase domain) than the nick to the first strand. In some embodiments, that different endonuclease domain is situated in an additional polypeptide (e.g., a system of the invention further comprises the additional polypeptide), separate from the gene modifying polypeptide. In some embodiments, the additional polypeptide comprises an endonuclease domain (e.g., nickase domain) described herein. In some embodiments, the additional polypeptide comprises a DNA binding domain, e.g., described herein.

It is contemplated herein that the position at which the second strand nick occurs relative to the first strand nick may influence the extent to which one or more of: desired gene modifying DNA modifications are obtained, undesired double-strand breaks (DSBs) occur, undesired insertions occur, or undesired deletions occur. Without wishing to be bound by theory, second strand nicking may occur in two general orientations: inward nicks and outward nicks.

In some embodiments, in the inward nick orientation, the RT domain polymerizes (e.g., using the template RNA (e.g., the heterologous object sequence)) away from the second strand nick. In some embodiments, in the inward nick orientation, the location of the nick to the first strand and the location of the nick to the second strand are positioned between the first PAM site and second PAM site (e.g., in a scenario wherein both nicks are made by a polypeptide (e.g., a gene modifying polypeptide) comprising a CRISPR/Cas domain). When there are two PAMs on the outside and two nicks on the inside, this inward nick orientation can also be referred to as "PAM-out". In some embodiments, in the inward nick orientation, the location of the nick to the first strand and the location of the nick to the second strand are between the sites where the polypeptide and the additional polypeptide bind to the target DNA. In some embodiments, in the inward nick orientation, the location of the nick to the second strand is positioned between the binding sites of the polypeptide and additional polypeptide, and the nick to the first strand is also located between the binding sites of the polypeptide and additional polypeptide. In some embodiments, in the inward nick orientation, the location of the nick to the first strand and the location of the nick to the second strand are positioned between the PAM site and the binding site of the second polypeptide which is at a distance from the target site.

An example of a gene modifying system that provides an inward nick orientation comprises a gene modifying polypeptide comprising a CRISPR/Cas domain, a template RNA comprising a gRNA that directs nicking of the target site DNA on the first strand, and an additional nucleic acid comprising an additional gRNA that directs nicking at a site a distance from the location of the first nick, wherein the location of the first nick and the location of the second nick are between the PAM sites of the sites to which the two gRNAs direct the gene modifying polypeptide. As a further example, another gene modifying system that provides an inward nick orientation comprises a gene modifying polypeptide comprising a zinc finger molecule and a first nickase domain wherein the zinc finger molecule binds to the target DNA in a manner that directs the first nickase domain to nick the first strand of the target site; an additional polypeptide comprising a CRISPR/Cas domain, and an additional nucleic acid comprising a gRNA that directs the additional polypeptide to nick a site a distance from the target site DNA on the second strand, wherein the location of the first nick and the location of the second nick are between the PAM site and the site to which the zinc finger molecule binds. As a further example, another gene modifying system that provides an inward nick orientation comprises a gene modifying polypeptide comprising a zinc finger molecule and a first nickase domain wherein the zinc finger molecule binds to the target DNA in a manner that directs the first nickase domain to nick the first strand of the target site; an additional polypeptide comprising a TAL effector molecule and a second nickase domain wherein the TAL effector molecule binds to a site a distance from the target site in a manner that directs the additional polypeptide to nick the second strand, wherein the location of the first nick and the location of the second nick are between the site to which the TAL effector molecule binds and the site to which the zinc finger molecule binds.

In some embodiments, in the outward nick orientation, the RT domain polymerizes (e.g., using the template RNA (e.g., the heterologous object sequence)) toward the second strand nick. In some embodiments, in the outward nick orientation when both the first and second nicks are made by a polypeptide comprising a CRISPR/Cas domain (e.g., a gene modifying polypeptide), the first PAM site and second PAM site are positioned between the location of the nick to the first strand and the location of the nick to the second strand. When there are two PAMs on the inside and two nicks on the outside, this outward nick orientation also can be referred to as "PAM-in". In some embodiments, in the outward nick orientation, the polypeptide (e.g., the gene modifying polypeptide) and the additional polypeptide bind to sites on the target DNA between the location of the nick to the first strand and the location of the nick to the second. In some embodiments, in the outward nick orientation, the location of the nick to the second strand is positioned on the opposite side of the binding sites of the polypeptide and additional polypeptide relative to the location of the nick to the first strand. In some embodiments, in the outward orientation, the PAM site and the binding site of the second polypeptide which is at a distance from the target site are positioned between the location of the nick to the first strand and the location of the nick to the second strand.

An example of a gene modifying system that provides an outward nick orientation comprises a gene modifying polypeptide comprising a CRISPR/Cas domain, a template RNA comprising a gRNA that directs nicking of the target site DNA on the first strand, and an additional nucleic acid comprising an additional gRNA that directs nicking at a site a distance from the location of the first nick, wherein the location of the first nick and the location of the second nick are outside of the PAM sites of the sites to which the two gRNAs direct the gene modifying polypeptide (i.e., the PAM sites are between the location of the first nick and the location of the second nick). As a further example, another gene modifying system that provides an outward nick orientation comprises a gene modifying polypeptide comprising a zinc finger molecule and a first nickase domain wherein the zinc finger molecule binds to the target DNA in a manner that directs the first nickase domain to nick the first strand of the target site; an additional polypeptide comprising a CRISPR/Cas domain, and an additional nucleic acid comprising a gRNA that directs the additional polypeptide to nick a site a distance from the target site DNA on the second strand, wherein the location of the first nick and the location of the second nick are outside the PAM site and the site to which the zinc finger molecule binds (i.e., the PAM site and the site to which the zinc finger molecule binds are between the location of the first nick and the location of the second nick). As a further example, another gene modifying system that provides an outward nick orientation comprises a gene modifying polypeptide comprising a zinc finger molecule and a first nickase domain wherein the zinc finger molecule binds to the target DNA in a manner that directs the first nickase domain to nick the first strand of the target site; an additional polypeptide comprising a TAL effector molecule and a second nickase domain wherein the TAL effector molecule binds to a site a distance from the target site in a manner that directs the additional polypeptide to nick the second strand, wherein the location of the first nick and the location of the second nick are outside the site to which the TAL effector molecule binds and the site to which the zinc finger molecule binds (i.e., the site to which the TAL effector molecule binds and the site to which the zinc finger molecule binds are between the location of the first nick and the location of the second nick).

Without wishing to be bound by theory, it is thought that, for gene modifying systems where a second strand nick is provided, an outward nick orientation is preferred in some embodiments. As is described herein, an inward nick may produce a higher number of double-strand breaks (DSBs) than an outward nick orientation. DSBs may be recognized by the DSB repair pathways in the nucleus of a cell, which can result in undesired insertions and deletions. An outward nick orientation may provide a decreased risk of DSB formation, and a corresponding lower amount of undesired insertions and deletions. In some embodiments, undesired insertions and deletions are insertions and deletions not encoded by the heterologous object sequence, e.g., an insertion or deletion produced by the double-strand break repair pathway unrelated to the modification encoded by the heterologous object sequence. In some embodiments, a desired gene modification comprises a change to the target DNA (e.g., a substitution, insertion, or deletion) encoded by the heterologous object sequence (e.g., and achieved by the gene modifying writing the heterologous object sequence into the target site). In some embodiments, the first strand nick and the second strand nick are in an outward orientation.

In addition, the distance between the first strand nick and second strand nick may influence the extent to which one or more of: desired gene modifying system DNA modifications are obtained, undesired double-strand breaks (DSBs) occur, undesired insertions occur, or undesired deletions occur. Without wishing to be bound by theory, it is thought the second strand nick benefit, the biasing of DNA repair toward incorporation of the heterologous object sequence into the target DNA, increases as the distance between the first strand nick and second strand nick decreases. However, it is thought that the risk of DSB formation also increases as the distance between the first strand nick and second strand nick decreases. Correspondingly, it is thought that the number of undesired insertions and/or deletions may increase as the distance between the first strand nick and second strand nick decreases. In some embodiments, the distance between the first strand nick and second strand nick is chosen to balance the benefit of biasing DNA repair toward incorporation of the heterologous object sequence into the target DNA and the risk of DSB formation and of undesired deletions and/or insertions. In some embodiments, a system where the first strand nick and the second strand nick are at least a threshold distance apart has an increased level of desired gene modifying system modification outcomes, a decreased level of undesired deletions, and/or a decreased level of undesired insertions relative to an otherwise similar inward nick orientation system where the first nick and the second nick are less than the a threshold distance apart. In some embodiments the threshold distance(s) is given below.

In some embodiments, the first nick and the second nick are at least 20, 25, 30, 35, 40, 45, 50, 55, 60, 65, 70, 75, 80, 85, 90, 95, 100, 110, 120, 130, 140, 150, 160, 170, 180, 190, or 200 nucleotides apart. In some embodiments, the first nick and the second nick are no more than 25, 30, 35, 40, 45, 50, 55, 60, 65, 70, 75, 80, 85, 90, 95, 100, 110, 120, 130, 140, 150, 160, 170, 180, 190, 200, or 250 nucleotides apart. In some embodiments, the first nick and the second nick are 20-200, 30-200, 40-200, 50-200, 60-200, 70-200, 80-200, 90-200, 100-200, 110-200, 120-200, 130-200, 140-200, 150-200, 160-200, 170-200, 180-200, 190-200, 20-190, 30-190, 40-190, 50-190, 60-190, 70-190, 80-190, 90-190, 100-190, 110-190, 120-190, 130-190, 140-190, 150-190, 160-190, 170-190, 180-190, 20-180, 30-180, 40-180, 50-180, 60-180, 70-180, 80-180, 90-180, 100-180, 110-180, 120-180, 130-180, 140-180, 150-180, 160-180, 170-180, 20-170, 30-170, 40-170, 50-170, 60-170, 70-170, 80-170, 90-170, 100-170, 110-170, 120-170, 130-170, 140-170, 150-170, 160-170, 20-160, 30-160, 40-160, 50-160, 60-160, 70-160, 80-160, 90-160, 100-160, 110-160, 120-160, 130-160, 140-160, 150-160, 20-150, 30-150, 40-150, 50-150, 60-150, 70-150, 80-150, 90-150, 100-150, 110-150, 120-150, 130-150, 140-150, 20-140, 30-140, 40-140, 50-140, 60-140, 70-140, 80-140, 90-140, 100-140, 110-140, 120-140, 130-140, 20-130, 30-130, 40-130, 50-130, 60-130, 70-130, 80-130, 90-130, 100-130, 110-130, 120-130, 20-120, 30-120, 40-120, 50-120, 60-120, 70-120, 80-120, 90-120, 100-120, 110-120, 20-110, 30-110, 40-110, 50-110, 60-110, 70-110, 80-110, 90-110, 100-110, 20-100, 30-100, 40-100, 50-100, 60-100, 70-100, 80-100, 90-100, 20-90, 30-90, 40-90, 50-90, 60-90, 70-90, 80-90, 20-80, 30-80, 40-80, 50-80, 60-80, 70-80, 20-70, 30-70, 40-70, 50-70, 60-70, 20-60, 30-60, 40-60, 50-60, 20-50, 30-50, 40-50, 20-40, 30-40, or 20-30 nucleotides apart. In some embodiments, the first nick and the second nick are 40-100 nucleotides apart.

Without wishing to be bound by theory, it is thought that, for gene modifying systems where a second strand nick is provided and an inward nick orientation is selected, increasing the distance between the first strand nick and second strand nick may be preferred. As is described herein, an inward nick orientation may produce a higher number of DSBs than an outward nick orientation, and may result in a higher amount of undesired insertions and deletions than an outward nick orientation, but increasing the distance between the nicks may mitigate that increase in DSBs, undesired deletions, and/or undesired insertions. In some embodiments, an inward nick orientation wherein the first nick and the second nick are at least a threshold distance apart has an increased level of desired gene modifying system modification outcomes, a decreased level of undesired deletions, and/or a decreased level of undesired insertions relative to an otherwise similar inward nick orientation system where the first nick and the second nick are less than the a threshold distance apart. In some embodiments the threshold distance is given below.

In some embodiments, the first strand nick and the second strand nick are in an inward orientation. In some embodiments, the first strand nick and the second strand nick are in an inward orientation and the first strand nick and second strand nick are at least 100, 110, 120, 130, 140, 150, 160, 170, 180, 190, 200, 220, 240, 260, 280, 300, 350, 400, 450, or 500 nucleotides apart, e.g., at least 100 nucleotides apart, (and optionally no more than 500, 400, 300, 200, 190, 180, 170, 160, 150, 140, 130, or 120 nucleotides apart). In some embodiments, the first strand nick and the second strand nick are in an inward orientation and the first strand nick and second strand nick are 100-200, 110-200, 120-200, 130-200, 140-200, 150-200, 160-200, 170-200, 180-200, 190-200, 100-190, 110-190, 120-190, 130-190, 140-190, 150-190, 160-190, 170-190, 180-190, 100-180, 110-180, 120-180, 130-180, 140-180, 150-180, 160-180, 170-180, 100-170, 110-170, 120-170, 130-170, 140-170, 150-170, 160-170, 100-160, 110-160, 120-160, 130-160, 140-160, 150-160, 100-150, 110-150, 120-150, 130-150, 140-150, 100-140, 110-140, 120-140, 130-140, 100-130, 110-130, 120-130, 100-120, 110-120, or 100-110 nucleotides apart.

Chemically Modified Nucleic Acids and Nucleic Acid End Features

A nucleic acid described herein (e.g., a template nucleic acid, e.g., a template RNA; or a nucleic acid (e.g., mRNA) encoding a gene modifying polypeptide; or a gRNA) can comprise unmodified or modified nucleobases. Naturally occurring RNAs are synthesized from four basic ribonucleotides: ATP, CTP, UTP and GTP, but may contain post-transcriptionally modified nucleotides. Further, approximately one hundred different nucleoside modifications have been identified in RNA (Rozenski, J, Crain, P, and McCloskey, J. (1999). The RNA Modification Database: 1999 update. Nucl Acids Res 27: 196-197). An RNA can also comprise wholly synthetic nucleotides that do not occur in nature.

In some embodiments, the chemical modification is one provided in WO/2016/183482, US Pat. Pub. No. 20090286852, of International Application No. WO/2012/019168, WO/2012/045075, WO/2012/135805, WO/2012/158736, WO/2013/039857, WO/2013/039861, WO/2013/052523, WO/2013/090648, WO/2013/096709, WO/2013/101690, WO/2013/106496, WO/2013/130161, WO/2013/151669, WO/2013/151736, WO/2013/151672, WO/2013/151664, WO/2013/151665, WO/2013/151668, WO/2013/151671, WO/2013/151667, WO/2013/151670, WO/2013/151666, WO/2013/151663, WO/2014/028429, WO/2014/081507, WO/2014/093924, WO/2014/093574, WO/2014/113089, WO/2014/144711, WO/2014/144767, WO/2014/144039, WO/2014/152540, WO/2014/152030, WO/2014/152031, WO/2014/152027, WO/2014/152211, WO/2014/158795, WO/2014/159813, WO/2014/164253, WO/2015/006747, WO/2015/034928, WO/2015/034925, WO/2015/038892, WO/2015/048744, WO/2015/051214, WO/2015/051173, WO/2015/051169, WO/2015/058069, WO/2015/085318, WO/2015/089511, WO/2015/105926, WO/2015/164674, WO/2015/196130, WO/2015/196128, WO/2015/196118, WO/2016/011226, WO/2016/011222, WO/2016/011306, WO/2016/014846, WO/2016/022914, WO/2016/036902, WO/2016/077125, or WO/2016/077123, each of which is herein incorporated by reference in its entirety. It is understood that incorporation of a chemically modified nucleotide into a polynucleotide can result in the modification being incorporated into a nucleobase, the backbone, or both, depending on the location of the modification in the nucleotide. In some embodiments, the backbone modification is one provided in EP 2813570, which is herein incorporated by reference in its entirety. In some embodiments, the modified cap is one provided in US Pat. Pub. No. 20050287539, which is herein incorporated by reference in its entirety.

In some embodiments, the chemically modified nucleic acid (e.g., RNA, e.g., mRNA) comprises one or more of ARCA: anti-reverse cap analog (m27.3'-OGP3G), GP3G (Unmethylated Cap Analog), m7GP3G (Monomethylated Cap Analog), m32.2.7GP3G (Trimethylated Cap Analog), m5CTP (5'-methyl-cytidine triphosphate), m6ATP (N6-methyl-adenosine-5'-triphosphate), s2UTP (2-thio-uridine triphosphate), and Ψ (pseudouridine triphosphate).

In some embodiments, the chemically modified nucleic acid comprises a 5' cap, e.g.: a 7-methylguanosine cap (e.g., a O-Me-m7G cap); a hypermethylated cap analog; an NAD+-derived cap analog (e.g., as described in Kiledjian, Trends in Cell Biology 28, 454-464 (2018)); or a modified, e.g., biotinylated, cap analog (e.g., as described in Bednarek et al., Phil Trans R Soc B 373, 20180167 (2018)).

In some embodiments, the chemically modified nucleic acid comprises a 3' feature selected from one or more of: a polyA tail; a 16-nucleotide long stem-loop structure flanked by unpaired 5 nucleotides (e.g., as described by Manniróni et al., Nucleic Acid Research 17, 9113-9126 (1989)); a triple-helical structure (e.g., as described by Brown et al., PNAS 109, 19202-19207 (2012)); a tRNA, Y RNA, or vault RNA structure (e.g., as described by Labno et al., Biochemica et Biophysica Acta 1863, 3125-3147 (2016)); incorporation of one or more deoxyribonucleotide triphosphates (dNTPs), 2'O-Methylated NTPs, or phosphorothioate-NTPs; a single nucleotide chemical modification (e.g., oxidation of the 3' terminal ribose to a reactive aldehyde followed by conjugation of the aldehyde-reactive modified nucleotide); or chemical ligation to another nucleic acid molecule.

In some embodiments, the nucleic acid (e.g., template nucleic acid) comprises one or more modified nucleotides, e.g., selected from dihydrouridine, inosine, 7-methylguanosine, 5-methylcytidine (5mC), 5' Phosphate ribothymidine, 2'-O-methyl ribothymidine, 2'-O-ethyl ribothymidine, 2'-fluoro ribothymidine, C-5 propynyl-deoxycytidine (pdC), C-5 propynyl-deoxyuridine (pdU), C-5 propynyl-cytidine (pC), C-5 propynyl-uridine (pU), 5-methyl cytidine, 5-methyl uridine, 5-methyl deoxycytidine, 5-methyl deoxyuridine methoxy, 2,6-diaminopurine, 5'-Dimethoxytrityl-N4-ethyl-2'-deoxycytidine, C-5 propynyl-f-cytidine (pfC), C-5 propynyl-f-uridine (pfU), 5-methyl f-cytidine, 5-methyl f-uridine, C-5 propynyl-m-cytidine (pmC), C-5 propynyl-f-uridine (pmU), 5-methyl m-cytidine, 5-methyl m-uridine, LNA (locked nucleic acid), MGB (minor groove binder) pseudouridine (Ψ), 1-N-methylpseudouridine (1-Me-Ψ), or 5-methoxyuridine (5-MO-U).

In some embodiments, the nucleic acid comprises a backbone modification, e.g., a modification to a sugar or phosphate group in the backbone. In some embodiments, the nucleic acid comprises a nucleobase modification.

In some embodiments, the nucleic acid comprises one or more chemically modified nucleotides of Table 13, one or more chemical backbone modifications of Table 14, one or more chemically modified caps of Table 15. For instance, in some embodiments, the nucleic acid comprises two or more (e.g., 3, 4, 5, 6, 7, 8, 9, or 10 or more) different types of chemical modifications. As an example, the nucleic acid may comprise two or more (e.g., 3, 4, 5, 6, 7, 8, 9, or 10 or more) different types of modified nucleobases, e.g., as described herein, e.g., in Table 13. Alternatively or in combination, the nucleic acid may comprise two or more (e.g., 3, 4, 5, 6, 7, 8, 9, or 10 or more) different types of backbone modifications, e.g., as described herein, e.g., in Table 14. Alternatively or in combination, the nucleic acid may comprise one or more modified cap, e.g., as described herein, e.g., in Table 15. For instance, in some embodiments, the nucleic acid comprises one or more type of modified nucleobase and one or more type of backbone modification; one or more type of modified nucleobase and one or more modified cap; one or more type of modified cap and one or more type of backbone modification; or one or more type of modified nucleobase, one or more type of backbone modification, and one or more type of modified cap.

In some embodiments, the nucleic acid comprises one or more (e.g., 2, 3, 4, 5, 6, 7, 8, 9, 10, 20, 30, 40, 50, 60, 70, 80, 90, 100, 150, 200, 250, 300, 350, 400, 450, 500, 600, 700, 800, 900, 1000, or more) modified nucleobases. In some embodiments, all nucleobases of the nucleic acid are modified. In some embodiments, the nucleic acid is modified at one or more (e.g., 2, 3, 4, 5, 6, 7, 8, 9, 10, 20, 30, 40, 50, 60, 70, 80, 90, 100, 150, 200, 250, 300, 350, 400, 450, 500, 600, 700, 800, 900, 1000, or more) positions in the backbone. In some embodiments, all backbone positions of the nucleic acid are modified.

TABLE 13

| Modified nucleotides | |
|---|---|
| 5-aza-uridine | N2-methyl-6-thio-guanosine |
| 2-thio-5-aza-midine | N2,N2-dimethyl-6-thio-guanosine |
| 2-thiouridine | pyridin-4-one ribonucleoside |
| 4-thio-pseudouridine | 2-thio-5-aza-uridine |
| 2-thio-pseudouridine | 2-thiomidine |
| 5-hydroxyuridine | 4-thio-pseudomidine |
| 3-methyluridine | 2-thio-pseudowidine |
| 5-carboxymethyl-uridine | 3-methylmidine |
| 1-carboxymethyl-pseudouridine | 1-propynyl-pseudomidine |
| 5-propynyl-uridine | 1-methyl-1-deaza-pseudomidine |
| 1-propynyl-pseudouridine | 2-thio-1-methyl-1-deaza-pseudouridine |
| 5-taurinomethyluridine | 4-methoxy-pseudomidine |
| 1-taurinomethyl-pseudouridine | 5'-O-(1-Thiophosphate)-Adenosine |
| 5-taurinomethyl-2-thio-uridine | 5'-O-(1-Thiophosphate)-Cytidine |
| 1-taurinomethyl-4-thio-uridine | 5'-O-(1-thiophosphate)-Guanosine |
| 5-methyl-uridine | 5'-O-(1-Thiophophate)-Uridine |
| 1-methyl-pseudouridine | 5'-O-(1-Thiophosphate)-Pseudouridine |
| 4-thio-1-methyl-pseudouridine | 2'-O-methyl-Adenosine |
| 2-thio-1-methyl-pseudouridine | 2'-O-methyl-Cytidine |
| 1-methyl-1-deaza-pseudouridine | 2'-O-methyl-Guanosine |
| 2-thio-1-methyl-1-deaza-pseudomidine | 2'-O-methyl-Uridine |
| dihydrouridine | 2'-O-methyl-Pseudouridine |
| dihydropseudouridine | 2'-O-methyl-Inosine |
| 2-thio-dihydromidine | 2-methyladenosine |
| 2-thio-dihydropseudouridine | 2-methylthio-N6-methyladenosine |
| 2-methoxyuridine | 2-methylthio-N6 isopentenyladenosine |
| 2-methoxy-4-thio-uridine | 2-methylthio-N6-(cis-hydroxyisopentenyl)adenosine |
| 4-methoxy-pseudouridine | N6-methyl-N6-threonylcarbamoyladenosine |
| 4-methoxy-2-thio-pseudouridine | N6-hydroxynorvalylcarbamoyladenosine |
| 5-aza-cytidine | 2-methylthio-N6-hydroxynorvalyl carbamoyladenosine |
| pseudoisocytidine | 2'-O-ribosyladenosine (phosphate) |
| 3-methyl-cytidine | 1,2'-O-dimethylinosine |
| N4-acetylcytidine | 5,2'-O-dimethylcytidine |
| 5-formylcytidine | N4-acetyl-2'-O-methylcytidine |
| N4-methylcytidine | Lysidine |
| 5-hydroxymethylcytidine | 7-methylguanosine |
| 1-methyl-pseudoisocytidine | N2,2'-O-dimethylguanosine |
| pyrrolo-cytidine | N2,N2,2'-O-trimethylguanosine |
| pyrrolo-pseudoisocytidine | 2'-O-ribosylguanosine (phosphate) |
| 2-thio-cytidine | Wybutosine |
| 2-thio-5-methyl-cytidine | Peroxywybutosine |
| 4-thio-pseudoisocytidine | Hydroxywybutosine |
| 4-thio-1-methyl-pseudoisocytidine | undermodified hydroxywybutosine |
| 4-thio-1-methyl-1-deaza-pseudoisocytidine | methylwyosine |
| 1-methyl-1-deaza-pseudoisocytidine | queuosine |
| zebularine | epoxyqueuosine |
| 5-aza-zebularine | galactosyl-queuosine |
| 5-methyl-zebularine | mannosyl-queuosine |
| 5-aza-2-thio-zebularine | |
| 2-thio-zebularine | |

TABLE 13-continued

| Modified nucleotides | |
|---|---|
| 2-methoxy-cytidine | 7-cyano-7-deazaguanosine |
| 2-methoxy-5-methyl-cytidine | 7-aminomethyl-7-deazaguanosine |
| 4-methoxy-pseudoisocytidine | archaeosine |
| 4-methoxy-1-methyl-pseudoisocytidine | 5,2'-O-dimethyluridine |
| 2-aminopurine | 4-thiouridine |
| 2,6-diaminopurine | 5-methyl-2-thiouridine |
| 7-deaza-adenine | 2-thio-2'-O-methyluridine |
| 7-deaza-8-aza-adenine | 3-(3-amino-3-carboxypropyl)uridine |
| 7-deaza-2-aminopurine | 5-methoxyuridine |
| 7-deaza-8-aza-2-aminopurine | uridine 5-oxyacetic acid |
| 7-deaza-2,6- diaminopurine | uridine 5-oxyacetic acid methyl ester |
| 7-deaza-8-aza-2,6-diarninopurine | 5-(carboxyhydroxymethyl)uridine) |
| 1-methyladenosine | 5-(carboxyhydroxymethyl)uridine methyl ester |
| N6-isopentenyladenosine | 5-methoxycarbonylmethyluridine |
| N6-(cis-hydroxyisopentenyl)adenosine | 5-methoxycarbonylmethyl-2'-O-methyluridine |
| 2-methylthio-N6-(cis-hydroxyisopentenyl) adenosine | 5-methoxycarbonylmethyl-2-thiouridine |
| | 5-aminomethyl-2-thiouridine |
| N6-glycinylcarbamoyladenosine | 5-methylaminomethyluridine |
| N6-threonylcarbamoyladenosine | 5-methylaminomethyl-2-thiouridine |
| 2-methylthio-N6-threonyl carbamoyladenosine | 5-methylaminomethyl-2-selenouridine |
| | 5-carbamoylmethyluridine |
| N6,N6-dimethyladenosine | 5-carbamoylmethyl-2'-O-methyluridine |
| 7-methyladenine | 5-carboxymethylaminomethyluridine |
| 2-methylthio-adenine | 5-carboxymethylaminomethyl-2'-O-methyluridine |
| 2-methoxy-adenine | |
| inosine | 5-carboxymethylaminomethyl-2-thiouridine |
| 1-methyl-inosine | N4,2'-O-dimethylcytidine |
| wyosine | 5-carboxymethyluridine |
| wybutosine | N6,2'-O-dimethyladenosine |
| 7-deaza-guanosine | N,N6,O-2'-trimethyladenosine |
| 7-deaza-8-aza-guanosine | N2,7-dimethylguanosine |
| 6-thio-guanosine | N2,N2,7-trimethylguanosine |
| 6-thio-7-deaza-guanosine | 3,2'-O-dimethyluridine |
| 6-thio-7-deaza-8-aza-guanosine | 5-methyldihydrouridine |
| 7-methyl-guanosine | 5-formyl-2'-O-methylcytidine |
| 6-thio-7-methyl-guanosine | 1,2'-O-dimethylguanosine |
| 7-methylinosine | 4-demethylwyosine |
| 6-methoxy-guanosine | Isowyosine |
| 1-methylguanosine | N6-acetyladenosine |
| N2-methylguanosine | |
| N2,N2-dimethylguanosine | |
| 8-oxo-guanosine | |
| 7-methyl-8-oxo-guanosine | |
| 1-methyl-6-thio-guanosine | |

TABLE 14

| Backbone modifications |
|---|
| 2'-O-Methyl backbone |
| Peptide Nucleic Acid (PNA) backbone |
| phosphorothioate backbone |
| morpholino backbone |
| carbamate backbone |
| siloxane backbone |
| sulfide backbone |
| sulfoxide backbone |
| sulfone backbone |
| formacetyl backbone |
| thioformacetyl backbone |
| methyleneformacetyl backbone |
| riboacetyl backbone |
| alkene containing backbone |
| sulfamate backbone |
| sulfonate backbone |
| sulfonamide backbone |
| methyleneimino backbone |
| methylenehydrazino backbone |
| amide backbone |

TABLE 15

| Modified caps |
|---|
| m7GpppA |
| m7GpppC |
| m2,7GpppG |
| m2,2,7GpppG |
| m7Gpppm7G |
| m7,2'OmeGpppG |
| m72'dGpppG |
| m7,3'OmeGpppG |
| m7,3'dGpppG |
| GppppG |
| m7GppppG |
| m7GppppA |
| m7GppppC |
| m2,7GppppG |
| m2,2,7GppppG |
| m7Gppppm7G |
| m7,2'OmeGppppG |
| m72'dGppppG |
| m7,3'OmeGppppG |
| m7,3'dGppppG |

The nucleotides comprising the template of the gene modifying system can be natural or modified bases, or a combination thereof. For example, the template may contain pseudouridine, dihydrouridine, inosine, 7-methylguanosine, or other modified bases. In some embodiments, the template may contain locked nucleic acid nucleotides. In some embodiments, the modified bases used in the template do not inhibit the reverse transcription of the template. In some embodiments, the modified bases used in the template may improve reverse transcription, e.g., specificity or fidelity.

In some embodiments, an RNA component of the system (e.g., a template RNA or a gRNA) comprises one or more nucleotide modifications. In some embodiments, the modification pattern of a gRNA can significantly affect in vivo activity compared to unmodified or end-modified guides (e.g., as shown in FIG. 1D from Finn et al. *Cell Rep* 22(9):2227-2235 (2018); incorporated herein by reference in its entirety). Without wishing to be bound by theory, this process may be due, at least in part, to a stabilization of the RNA conferred by the modifications. Non-limiting examples of such modifications may include 2'-O-methyl (2'-O-Me), 2'-0-(2-methoxyethyl) (2'-0-MOE), 2'-fluoro (2'-F), phosphorothioate (PS) bond between nucleotides, G-C substitutions, and inverted abasic linkages between nucleotides and equivalents thereof.

In some embodiments, the template RNA (e.g., at the portion thereof that binds a target site) or the guide RNA comprises a 5' terminus region. In some embodiments, the template RNA or the guide RNA does not comprise a 5' terminus region. In some embodiments, the 5' terminus region comprises a gRNA spacer region, e.g., as described with respect to sgRNA in Briner AE et al, Molecular Cell 56: 333-339 (2014) (incorporated herein by reference in its entirety; applicable herein, e.g., to all guide RNAs). In some embodiments, the 5' terminus region comprises a 5' end modification. In some embodiments, a 5' terminus region with or without a spacer region may be associated with a crRNA, trRNA, sgRNA and/or dgRNA. The gRNA spacer region can, in some instances, comprise a guide region, guide domain, or targeting domain.

In some embodiments, the template RNAs (e.g., at the portion thereof that binds a target site) or guide RNAs described herein comprises any of the sequences shown in Table 4 of WO2018107028A1, incorporated herein by reference in its entirety. In some embodiments, where a sequence shows a guide and/or spacer region, the composition may comprise this region or not. In some embodiments, a guide RNA comprises one or more of the modifications of any of the sequences shown in Table 4 of WO2018107028A1, e.g., as identified therein by a SEQ ID NO. In embodiments, the nucleotides may be the same or different, and/or the modification pattern shown may be the same or similar to a modification pattern of a guide sequence as shown in Table 4 of WO2018107028A1. In some embodiments, a modification pattern includes the relative position and identity of modifications of the gRNA or a region of the gRNA (e.g. 5' terminus region, lower stem region, bulge region, upper stem region, nexus region, hairpin 1 region, hairpin 2 region, 3' terminus region). In some embodiments, the modification pattern contains at least 50%, 55%, 60%, 70%, 75%, 80%, 85%, 90%, 95%, 96%, 97%, 98%, 99%, or 100% of the modifications of any one of the sequences shown in the sequence column of Table 4 of WO2018107028A1, and/or over one or more regions of the sequence. In some embodiments, the modification pattern is at least 50%, 55%, 60%, 70%, 75%, 80%, 85%, 90%, 95%, 96%, 97%, 98%, 99%, or 100% identical to the modification pattern of any one of the sequences shown in the sequence column of Table 4 of WO2018107028A1. In some embodiments, the modification pattern is at least 50%, 55%, 60%, 70%, 75%, 80%, 85%, 90%, 95%, 96%, 97%, 98%, 99%, or 100% identical over one or more regions of the sequence shown in Table 4 of WO2018107028A1, e.g., in a 5' terminus region, lower stem region, bulge region, upper stem region, nexus region, hairpin 1 region, hairpin 2 region, and/or 3' terminus region. In some embodiments, the modification pattern is least 50%, 55%, 60%, 70%, 75%, 80%, 85%, 90%, 95%, 96%, 97%, 98%, 99%, or 100% identical to the modification pattern of a sequence over the 5' terminus region. In some embodiments, the modification pattern is least 50%, 55%, 60%, 70%, 75%, 80%, 85%, 90%, 95%, 96%, 97%, 98%, 99%, or 100% identical over the lower stem. In some embodiments, the modification pattern is least 50%, 55%, 60%, 70%, 75%, 80%, 85%, 90%, 95%, 96%, 97%, 98%, 99%, or 100% identical over the bulge. In some embodiments, the modification pattern is least 50%, 55%, 60%, 70%, 75%, 80%, 85%, 90%, 95%, 96%, 97%, 98%, 99%, or 100% identical over the upper stem. In some embodiments, the modification pattern is least 50%, 55%, 60%, 70%, 75%, 80%, 85%, 90%, 95%, 96%, 97%, 98%, 99%, or 100% identical over the nexus. In some embodiments, the modification pattern is least 50%, 55%, 60%, 70%, 75%, 80%, 85%, 90%, 95%, 96%, 97%, 98%, 99%, or 100% identical over the hairpin 1. In some embodiments, the modification pattern is least 50%, 55%, 60%, 70%, 75%, 80%, 85%, 90%, 95%, 96%, 97%, 98%, 99%, or 100% identical over the hairpin 2. In some embodiments, the modification pattern is least 50%, 55%, 60%, 70%, 75%, 80%, 85%, 90%, 95%, 96%, 97%, 98%, 99%, or 100% identical over the 3' terminus. In some embodiments, the modification pattern differs from the modification pattern of a sequence of Table 4 of WO2018107028A1, or a region (e.g. 5' terminus, lower stem, bulge, upper stem, nexus, hairpin 1, hairpin 2, 3' terminus) of such a sequence, e.g., at 0, 1, 2, 3, 4, 5, 6, or more nucleotides. In some embodiments, the gRNA comprises modifications that differ from the modifications of a sequence of Table 4 of WO2018107028A1, e.g., at 0, 1, 2, 3, 4, 5, 6, or more nucleotides. In some embodiments, the gRNA comprises modifications that differ from modifications of a region (e.g. 5' terminus, lower stem, bulge, upper stem, nexus, hairpin 1, hairpin 2, 3' terminus) of a sequence of Table 4 of WO2018107028A1, e.g., at 0, 1, 2, 3, 4, 5, 6, or more nucleotides.

In some embodiments, the template RNAs (e.g., at the portion thereof that binds a target site) or the gRNA comprises a 2'-O-methyl (2'-O-Me) modified nucleotide. In some embodiments, the gRNA comprises a 2'-O-(2-methoxy ethyl) (2'-O-moe) modified nucleotide. In some embodiments, the gRNA comprises a 2'-fluoro (2'-F) modified nucleotide. In some embodiments, the gRNA comprises a phosphorothioate (PS) bond between nucleotides. In some embodiments, the gRNA comprises a 5' end modification, a 3' end modification, or 5' and 3' end modifications. In some embodiments, the 5' end modification comprises a phosphorothioate (PS) bond between nucleotides. In some embodiments, the 5' end modification comprises a 2'-O-methyl (2'-O-Me), 2'-O-(2-methoxy ethyl) (2'-O-MOE), and/or 2'-fluoro (2'-F) modified nucleotide. In some embodiments, the 5' end modification comprises at least one phosphorothioate (PS) bond and one or more of a 2'-O-methyl (2'-O-Me), 2'-O-(2-methoxyethyl) (2'-O-MOE), and/or 2'-fluoro (2'-F) modified nucleotide. The end modification may comprise a phosphorothioate (PS), 2'-O-methyl (2'-O-Me), 2'-O-(2-methoxyethyl) (2'-O-MOE), and/or 2'-fluoro (2'-F) modification. Equivalent end modifications are also encompassed by embodiments described herein. In some embodiments, the template RNA or gRNA comprises an end modification in combination with a modification of one or more regions of the template RNA or gRNA. Additional exemplary modifications and methods for protecting RNA, e.g., gRNA, and formulae thereof, are described in WO2018126176A1, which is incorporated herein by reference in its entirety.

In some embodiments, a template RNA described herein comprises three phosphorothioate linkages at the 5' end and three phosphorothioate linkages at the 3' end. In some embodiments, a template RNA described herein comprises three 2'-O-methyl ribonucleotides at the 5' end and three 2'-O-methyl ribonucleotides at the 3' end. In some embodiments, the 5' most three nucleotides of the template RNA are 2'-O-methyl ribonucleotides, the 5' most three internucleotide linkages of the template RNA are phosphorothioate linkages, the 3' most three nucleotides of the template RNA are 2'-O-methyl ribonucleotides, and the 3' most three internucleotide linkages of the template RNA are phosphorothioate linkages. In some embodiments, the template RNA comprises alternating blocks of ribonucleotides and 2'-O-methyl ribonucleotides, for instance, blocks of between 12 and 28 nucleotides in length. In some embodiments, the central portion of the template RNA comprises the alternating blocks and the 5' and 3' ends each comprise three 2'-O-methyl ribonucleotides and three phosphorothioate linkages.

In some embodiments, structure-guided and systematic approaches are used to introduce modifications (e.g., 2'-OMe-RNA, 2'-F-RNA, and PS modifications) to a template RNA or guide RNA, for example, as described in Mir et al. *Nat Commun* 9:2641 (2018) (incorporated by reference herein in its entirety). In some embodiments, the incorporation of 2'-F-RNAs increases thermal and nuclease stability of RNA:RNA or RNA:DNA duplexes, e.g., while minimally interfering with C3'-endo sugar puckering. In some embodiments, 2'-F may be better tolerated than 2'-OMe at positions where the 2'-OH is important for RNA:DNA duplex stability. In some embodiments, a crRNA comprises one or more modifications that do not reduce Cas9 activity, e.g., C10, C20, or C21 (fully modified), e.g., as described in Supplementary Table 1 of Mir et al. *Nat Commun* 9:2641 (2018), incorporated herein by reference in its entirety. In some embodiments, a tracrRNA comprises one or more modifications that do not reduce Cas9 activity, e.g., T2, T6, T7, or T8 (fully modified) of Supplementary Table 1 of Mir et al. *Nat Commun* 9:2641 (2018). In some embodiments, a crRNA comprises one or more modifications (e.g., as described herein) may be paired with a tracrRNA comprising one or more modifications, e.g., C20 and T2. In some embodiments, a gRNA comprises a chimera, e.g., of a crRNA and a tracrRNA (e.g., Jinek et al. *Science* 337(6096): 816-821 (2012)). In embodiments, modifications from the crRNA and tracrRNA are mapped onto the single-guide chimera, e.g., to produce a modified gRNA with enhanced stability.

In some embodiments, gRNA molecules may be modified by the addition or subtraction of the naturally occurring structural components, e.g., hairpins. In some embodiments, a gRNA may comprise a gRNA with one or more 3' hairpin elements deleted, e.g., as described in WO2018106727, incorporated herein by reference in its entirety. In some embodiments, a gRNA may contain an added hairpin structure, e.g., an added hairpin structure in the spacer region, which was shown to increase specificity of a CRISPR-Cas system in the teachings of Kocak et al. *Nat Biotechnol* 37(6):657-666 (2019). Additional modifications, including examples of shortened gRNA and specific modifications improving in vivo activity, can be found in US20190316121, incorporated herein by reference in its entirety.

In some embodiments, structure-guided and systematic approaches (e.g., as described in Mir et al. *Nat Commun* 9:2641 (2018); incorporated herein by reference in its entirety) are employed to find modifications for the template RNA. In embodiments, the modifications are identified with the inclusion or exclusion of a guide region of the template RNA. In some embodiments, a structure of polypeptide bound to template RNA is used to determine non-protein-contacted nucleotides of the RNA that may then be selected for modifications, e.g., with lower risk of disrupting the association of the RNA with the polypeptide. Secondary structures in a template RNA can also be predicted in silico by software tools, e.g., the RNAstructure tool available at rna.urmc.rochester.edu/RNAstructureWeb (Bellaousov et al. *Nucleic Acids Res* 41:W471-W474 (2013); incorporated by reference herein in its entirety), e.g., to determine secondary structures for selecting modifications, e.g., hairpins, stems, and/or bulges.

Production of Compositions and Systems

As will be appreciated by one of skill, methods of designing and constructing nucleic acid constructs and proteins or polypeptides (such as the systems, constructs and polypeptides described herein) are routine in the art. Generally, recombinant methods may be used. See, in general, Smales & James (Eds.), *Therapeutic Proteins: Methods and Protocols* (Methods in Molecular Biology), Humana Press (2005); and Crommelin, Sindelar & Meibohm (Eds.), *Pharmaceutical Biotechnology: Fundamentals and Applications*, Springer (2013). Methods of designing, preparing, evaluating, purifying and manipulating nucleic acid compositions are described in Green and Sambrook (Eds.), *Molecular Cloning: A Laboratory Manual* (Fourth Edition), Cold Spring Harbor Laboratory Press (2012).

The disclosure provides, in part, a nucleic acid, e.g., vector, encoding a gene modifying polypeptide described herein, a template nucleic acid described herein, or both. In some embodiments, a vector comprises a selective marker, e.g., an antibiotic resistance marker. In some embodiments, the antibiotic resistance marker is a kanamycin resistance marker. In some embodiments, the antibiotic resistance marker does not confer resistance to beta-lactam antibiotics. In some embodiments, the vector does not comprise an ampicillin resistance marker. In some embodiments, the vector comprises a kanamycin resistance marker and does not comprise an ampicillin resistance marker. In some embodiments, a vector encoding a gene modifying polypeptide is integrated into a target cell genome (e.g., upon administration to a target cell, tissue, organ, or subject). In some embodiments, a vector encoding a gene modifying polypeptide is not integrated into a target cell genome (e.g., upon administration to a target cell, tissue, organ, or subject). In some embodiments, a vector encoding a template nucleic acid (e.g., template RNA) is not integrated into a target cell genome (e.g., upon administration to a target cell, tissue, organ, or subject). In some embodiments, if a vector is integrated into a target site in a target cell genome, the selective marker is not integrated into the genome. In some embodiments, if a vector is integrated into a target site in a target cell genome, genes or sequences involved in vector maintenance (e.g., plasmid maintenance genes) are not integrated into the genome. In some embodiments, if a vector is integrated into a target site in a target cell genome, transfer regulating sequences (e.g., inverted terminal repeats, e.g., from an AAV) are not integrated into the genome. In some embodiments, administration of a vector (e.g., encoding a gene modifying polypeptide described herein, a template nucleic acid described herein, or both) to a target cell, tissue, organ, or subject results in integration of a portion of the vector into one or more target sites in the genome(s) of said target cell, tissue, organ, or subject. In some embodiments, less than 99, 95, 90, 80, 70, 60, 50, 40, 30, 20, 10, 5, 4, 3, 2, or 1% of target sites (e.g., no target sites) comprising integrated material comprise a selective marker (e.g., an antibiotic resistance gene), a transfer regulating sequence (e.g., an inverted terminal repeat, e.g., from an AAV), or both from the vector.

Exemplary methods for producing a therapeutic pharmaceutical protein or polypeptide described herein involve expression in mammalian cells, although recombinant proteins can also be produced using insect cells, yeast, bacteria, or other cells under control of appropriate promoters. Mammalian expression vectors may comprise non-transcribed elements such as an origin of replication, a suitable promoter, and other 5' or 3' flanking non-transcribed sequences, and 5' or 3' non-translated sequences such as necessary ribosome binding sites, a polyadenylation site, splice donor and acceptor sites, and termination sequences. DNA sequences derived from the SV40 viral genome, for example, SV40 origin, early promoter, splice, and polyadenylation sites may be used to provide other genetic elements required for expression of a heterologous DNA sequence. Appropriate cloning and expression vectors for use with bacterial, fungal, yeast, and mammalian cellular hosts are described in Green & Sambrook, *Molecular Cloning: A Laboratory Manual* (Fourth Edition), Cold Spring Harbor Laboratory Press (2012).

Various mammalian cell culture systems can be employed to express and manufacture recombinant protein. Examples of mammalian expression systems include CHO, COS, HEK293, HeLA, and BHK cell lines. Processes of host cell culture for production of protein therapeutics are described in Zhou and Kantardjieff (Eds.), *Mammalian Cell Cultures for Biologics Manufacturing* (*Advances in Biochemical Engineering/Biotechnology*), Springer (2014). Compositions described herein may include a vector, such as a viral vector, e.g., a lentiviral vector, encoding a recombinant protein. In some embodiments, a vector, e.g., a viral vector, may comprise a nucleic acid encoding a recombinant protein.

Purification of protein therapeutics is described in Franks, Protein Biotechnology: *Isolation, Characterization, and Stabilization*, Humana Press (2013); and in Cutler, *Protein Purification Protocols* (*Methods in Molecular Biology*), Humana Press (2010).

The disclosure also provides compositions and methods for the production of template nucleic acid molecules (e.g., template RNAs) with specificity for a gene modifying polypeptide and/or a genomic target site. In an aspect, the method comprises production of RNA segments including an upstream homology segment, a heterologous object sequence segment, a gene modifying polypeptide binding motif, and a gRNA segment.

Therapeutic Applications

In some embodiments, a gene modifying system as described herein can be used to modify a cell (e.g., an animal cell, plant cell, or fungal cell). In some embodiments, a gene modifying system as described herein can be used to modify a mammalian cell (e.g., a human cell). In some embodiments, a gene modifying system as described herein can be used to modify a cell from a livestock animal (e.g., a cow, horse, sheep, goat, pig, llama, alpaca, camel, yak, chicken, duck, goose, or ostrich). In some embodiments, a gene modifying system as described herein can be used as a laboratory tool or a research tool, or used in a laboratory method or research method, e.g., to modify an animal cell, e.g., a mammalian cell (e.g., a human cell), a plant cell, or a fungal cell.

By integrating coding genes into a RNA sequence template, the gene modifying system can address therapeutic needs, for example, by providing expression of a therapeutic transgene in individuals with loss-of-function mutations, by replacing gain-of-function mutations with normal transgenes, by providing regulatory sequences to eliminate gain-of-function mutation expression, and/or by controlling the expression of operably linked genes, transgenes and systems thereof. In certain embodiments, the RNA sequence template encodes a promotor region specific to the therapeutic needs of the host cell, for example a tissue specific promotor or enhancer. In still other embodiments, a promotor can be operably linked to a coding sequence.

Accordingly, provided herein are methods for treating phenylketonuria (PKU) or hyperphenylalaninemia (e.g., mild or severe hyperphenylalaninemia) in a subject in need thereof. In some embodiments, treatment results in amelioration of one or more symptoms associated with PKU or hyperphenylalaninemia.

In some embodiments, a system herein is used to treat a subject having a mutation in R408 (e.g., R408W), R261 (e.g., R261Q), R243 (e.g., R243Q), and/or IVS10-11G (e.g., IVS10-11G>A).

In some embodiments, treatment with a system disclosed herein results in correction of the R408W, R261Q, R243Q, and/or IVS10-11G>A mutation in between about 5-50% (e.g., about 5-10%, 10-20%, 20-30%, 30-40%, 40-50%, or about 10%) of cells. In some embodiments, treatment with a system disclosed herein results in correction of the R408W, R261Q, R243Q, and/or IVS10-11G>A mutation in between about 5-50% (e.g., about 5-10%, 10-20%, 20-30%, 30-40%, 40-50%, or about 10%) of DNA from the treated cells.

In some embodiments, treatment with a gene modifying system described herein results in one or more of:

(a) an increase in phenylalanine hydroxylase (PAH) activity, efficiency, and/or function;
(b) a decrease in the concentration of phenylalanine in the blood and/or cerebrospinal fluid;
(c) increase in the concentration of tyrosine in the blood
(d) a restoration of normal synthesis of dopamine, norepinephrine, and/or melanin;
(e) a reduction in ureagenesis; and/or
(f) an improvement in protein retention and/or Phe utilization as compared to a subject having PKU that has not been treated with a gene modifying system described herein.

Administration and Delivery

The compositions and systems described herein may be used in vitro or in vivo. In some embodiments the system or components of the system are delivered to cells (e.g., mammalian cells, e.g., human cells), e.g., in vitro or in vivo. In some embodiments, the cells are eukaryotic cells, e.g., cells of a multicellular organism, e.g., an animal, e.g., a mammal (e.g., human, swine, bovine), a bird (e.g., poultry, such as chicken, turkey, or duck), or a fish. In some embodiments, the cells are non-human animal cells (e.g., a laboratory animal, a livestock animal, or a companion animal). In some embodiments, the cell is a stem cell (e.g., a hematopoietic stem cell), a fibroblast, or a T cell. In some embodiments, the cell is an immune cell, e.g., a T cell (e.g., a Treg, CD4, CD8, γδ, or memory T cell), B cell (e.g., memory B cell or plasma cell), or NK cell. In some embodiments, the cell is a non-dividing cell, e.g., a non-dividing fibroblast or non-dividing T cell. In some embodiments, the cell is an HSC and p53 is not upregulated or is upregulated by less than 10%, 5%, 2%, or 1%, e.g., as determined according to the method described in Example 30 of PCT/US2019/048607. The skilled artisan will understand that the components of the gene modifying system may be delivered in the form of polypeptide, nucleic acid (e.g., DNA, RNA), and combinations thereof.

In one embodiment the system and/or components of the system are delivered as nucleic acid. For example, the gene modifying polypeptide may be delivered in the form of a DNA or RNA encoding the polypeptide, and the template RNA may be delivered in the form of RNA or its complementary DNA to be transcribed into RNA. In some embodiments the system or components of the system are delivered on 1, 2, 3, 4, or more distinct nucleic acid molecules. In some embodiments the system or components of the system are delivered as a combination of DNA and RNA. In some embodiments the system or components of the system are delivered as a combination of DNA and protein. In some embodiments the system or components of the system are delivered as a combination of RNA and protein. In some embodiments the gene modifying polypeptide is delivered as a protein.

In some embodiments the system or components of the system are delivered to cells, e.g. mammalian cells or human cells, using a vector. The vector may be, e.g., a plasmid or a virus. In some embodiments, delivery is in vivo, in vitro, ex vivo, or in situ. In some embodiments the virus is an adeno associated virus (AAV), a lentivirus, or an adenovirus. In some embodiments the system or components of the system are delivered to cells with a viral-like particle or a virosome. In some embodiments the delivery uses more than one virus, viral-like particle or virosome.

In one embodiment, the compositions and systems described herein can be formulated in liposomes or other similar vesicles. Liposomes are spherical vesicle structures composed of a uni- or multilamellar lipid bilayer surrounding internal aqueous compartments and a relatively impermeable outer lipophilic phospholipid bilayer. Liposomes may be anionic, neutral or cationic. Liposomes are biocompatible, nontoxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Vesicles can be made from several different types of lipids; however, phospholipids are most commonly used to generate liposomes as drug carriers. Methods for preparation of multilamellar vesicle lipids are known in the art (see for example U.S. Pat. No. 6,693,086, the teachings of which relating to multilamellar vesicle lipid preparation are incorporated herein by reference). Although vesicle formation can be spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review). Extruded lipids can be prepared by extruding through filters of decreasing size, as described in Templeton et al., Nature Biotech, 15:647-652, 1997, the teachings of which relating to extruded lipid preparation are incorporated herein by reference.

A variety of nanoparticles can be used for delivery, such as a liposome, a lipid nanoparticle, a cationic lipid nanoparticle, an ionizable lipid nanoparticle, a polymeric nanoparticle, a gold nanoparticle, a dendrimer, a cyclodextrin nanoparticle, a micelle, or a combination of the foregoing.

Lipid nanoparticles are an example of a carrier that provides a biocompatible and biodegradable delivery system for the pharmaceutical compositions described herein. Nanostructured lipid carriers (NLCs) are modified solid lipid nanoparticles (SLNs) that retain the characteristics of the SLN, improve drug stability and loading capacity, and prevent drug leakage. Polymer nanoparticles (PNPs) are an important component of drug delivery. These nanoparticles can effectively direct drug delivery to specific targets and improve drug stability and controlled drug release. Lipid-polymer nanoparticles (PLNs), a type of carrier that combines liposomes and polymers, may also be employed. These nanoparticles possess the complementary advantages of PNPs and liposomes. A PLN is composed of a core-shell structure; the polymer core provides a stable structure, and the phospholipid shell offers good biocompatibility. As such, the two components increase the drug encapsulation efficiency rate, facilitate surface modification, and prevent leakage of water-soluble drugs. For a review, see, e.g., Li et al. 2017, Nanomaterials 7, 122; doi:10.3390/nano7060122.

Exosomes can also be used as drug delivery vehicles for the compositions and systems described herein. For a review, see Ha et al. July 2016. Acta Pharmaceutica Sinica B. Volume 6, Issue 4, Pages 287-296; doi.org/10.1016/j.apsb.2016.02.001.

Fusosomes interact and fuse with target cells, and thus can be used as delivery vehicles for a variety of molecules. They generally consist of a bilayer of amphipathic lipids enclosing a lumen or cavity and a fusogen that interacts with the amphipathic lipid bilayer. The fusogen component has been shown to be engineerable in order to confer target cell specificity for the fusion and payload delivery, allowing the creation of delivery vehicles with programmable cell specificity (see for example Patent Application WO2020014209, the teachings of which relating to fusosome design, preparation, and usage are incorporated herein by reference).

In some embodiments, the protein component(s) of the gene modifying system may be pre-associated with the template nucleic acid (e.g., template RNA). For example, in some embodiments, the gene modifying polypeptide may be first combined with the template nucleic acid (e.g., template RNA) to form a ribonucleoprotein (RNP) complex. In some embodiments, the RNP may be delivered to cells via, e.g., transfection, nucleofection, virus, vesicle, LNP, exosome, fusosome.

A gene modifying system can be introduced into cells, tissues and multicellular organisms. In some embodiments the system or components of the system are delivered to the cells via mechanical means or physical means.

Formulation of protein therapeutics is described in Meyer (Ed.), *Therapeutic Protein Drug Products: Practical Approaches to formulation in the Laboratory, Manufacturing, and the Clinic*, Woodhead Publishing Series (2012).

Tissue Specific Activity/Administration

In some embodiments, a system described herein can make use of one or more feature (e.g., a promoter or microRNA binding site) to limit activity in off-target cells or tissues.

In some embodiments, a nucleic acid described herein (e.g., a template RNA or a DNA encoding a template RNA) comprises a promoter sequence, e.g., a tissue specific promoter sequence. In some embodiments, the tissue-specific promoter is used to increase the target-cell specificity of a gene modifying system. For instance, the promoter can be chosen on the basis that it is active in a target cell type but not active in (or active at a lower level in) a non-target cell type. Thus, even if the promoter integrated into the genome of a non-target cell, it would not drive expression (or only drive low level expression) of an integrated gene. A system having a tissue-specific promoter sequence in the template RNA may also be used in combination with a microRNA binding site, e.g., in the template RNA or a nucleic acid encoding a gene modifying protein, e.g., as described herein. A system having a tissue-specific promoter sequence in the template RNA may also be used in combination with a DNA encoding a gene modifying polypeptide, driven by a tissue-specific promoter, e.g., to achieve higher levels of gene modifying protein in target cells than in non-target cells. In some embodiments, e.g., for liver indications, a tissue-specific promoter is selected from Table 3 of WO2020014209, incorporated herein by reference.

In some embodiments, a nucleic acid described herein (e.g., a template RNA or a DNA encoding a template RNA) comprises a microRNA binding site. In some embodiments, the microRNA binding site is used to increase the target-cell specificity of a gene modifying system. For instance, the microRNA binding site can be chosen on the basis that is recognized by a miRNA that is present in a non-target cell type, but that is not present (or is present at a reduced level relative to the non-target cell) in a target cell type. Thus, when the template RNA is present in a non-target cell, it would be bound by the miRNA, and when the template RNA is present in a target cell, it would not be bound by the miRNA (or bound but at reduced levels relative to the non-target cell). While not wishing to be bound by theory, binding of the miRNA to the template RNA may interfere with its activity, e.g., may interfere with insertion of the heterologous object sequence into the genome. Accordingly, the system would edit the genome of target cells more efficiently than it edits the genome of non-target cells, e.g., the heterologous object sequence would be inserted into the genome of target cells more efficiently than into the genome of non-target cells, or an insertion or deletion is produced more efficiently in target cells than in non-target cells. A system having a microRNA binding site in the template RNA (or DNA encoding it) may also be used in combination with a nucleic acid encoding a gene modifying polypeptide, wherein expression of the gene modifying polypeptide is regulated by a second microRNA binding site, e.g., as described herein. In some embodiments, e.g., for liver indications, a miRNA is selected from Table 4 of WO2020014209, incorporated herein by reference.

In some embodiments, the template RNA comprises a microRNA sequence, an siRNA sequence, a guide RNA sequence, or a piwi RNA sequence.

Promoters

In some embodiments, one or more promoter or enhancer elements are operably linked to a nucleic acid encoding a gene modifying protein or a template nucleic acid, e.g., that controls expression of the heterologous object sequence. In certain embodiments, the one or more promoter or enhancer elements comprise cell-type or tissue specific elements. In some embodiments, the promoter or enhancer is the same or derived from the promoter or enhancer that naturally controls expression of the heterologous object sequence. For example, the ornithine transcarbomylase promoter and enhancer may be used to control expression of the ornithine transcarbomylase gene in a system or method provided by the invention for correcting ornithine transcarbomylase deficiencies. In some embodiments, the promoter is a promoter of Table 16 or 17 or a functional fragment or variant thereof.

Exemplary tissue specific promoters that are commercially available can be found, for example, at a uniform resource locator (e.g., invivogen.com/tissue-specific-promoters). In some embodiments, a promoter is a native promoter or a minimal promoter, e.g., which consists of a single fragment from the 5' region of a given gene. In some embodiments, a native promoter comprises a core promoter and its natural 5' UTR. In some embodiments, the 5' UTR comprises an intron. In other embodiments, these include composite promoters, which combine promoter elements of different origins or were generated by assembling a distal enhancer with a minimal promoter of the same origin.

Exemplary cell or tissue specific promoters are provided in the tables, below, and exemplary nucleic acid sequences encoding them are known in the art and can be readily accessed using a variety of resources, such as the NCBI database, including RefSeq, as well as the Eukaryotic Promoter Database (//epd.epfl.ch//index.php).

TABLE 16

Exemplary cell or tissue-specific promoters

| Promoter | Target cells |
|---|---|
| B29 Promoter | B cells |
| CD14 Promoter | Monocytic Cells |
| CD43 Promoter | Leukocytes and platelets |
| CD45 Promoter | Hematopoeitic cells |
| CD68 promoter | macrophages |
| Desmin promoter | muscle cells |
| Elastase-1 promoter | pancreatic acinar cells |
| Endoglin promoter | endothelial cells |
| fibronectin promoter | differentiating cells, healing tissue |
| Flt-1 promoter | endothelial cells |
| GFAP promoter | Astrocytes |
| GPIIB promoter | megakaryocytes |
| ICAM-2 Promoter | Endothelial cells |
| INF-Beta promoter | Hematopoeitic cells |
| Mb promoter | muscle cells |
| Nphs1 promoter | podocytes |
| OG-2 promoter | Osteoblasts, Odonblasts |
| SP-B promoter | Lung |
| Syn1 promoter | Neurons |
| WASP promoter | Hematopoeitic cells |
| SV40/bAlb promoter | Liver |
| SV40/bAlb promoter | Liver |
| SV40/Cd3 promoter | Leukocytes and platelets |
| SV40/CD45 promoter | hematopoeitic cells |
| NSE/RU5' promoter | Mature Neurons |

TABLE 17

Additional exemplary cell or tissue-specific promoters

| Promoter | Gene Description | Gene Specificity |
|---|---|---|
| APOA2 | Apolipoprotein A-II | Hepatocytes (from hepatocyte progenitors) |

TABLE 17-continued

| Promoter | Gene Description | Gene Specificity |
|---|---|---|
| Additional exemplary cell or tissue-specific promoters | | |
| SERPINA 1 (hAAT) | Serpin peptidase inhibitor, clade A (alpha-1 antiproteinase, antitrypsin), member 1 (also named alpha 1 anti-tryps in) | Hepatocytes (from definitive endoderm stage) |
| CYP3A | Cytochrome P450, family 3, subfamily A, polypeptide | Mature Hepatocytes |
| MIR122 | MicroRNA 122 | Hepatocytes (from early stage embryonic liver cells) and endoderm |
| Pancreatic specific promoters | | |
| INS | Insulin | Pancreatic beta cells (from definitive endoderm stage) |
| IRS2 | Insulin receptor substrate 2 | Pancreatic beta cells |
| Pdx1 | Pancreatic and duodenal homeobox 1 | Pancreas (from definitive endoderm stage) |
| Alx3 | Aristaless-like homeobox 3 | Pancreatic beta cells (from definitive endoderm stage) |
| Ppy | Pancreatic polypeptide | PP pancreatic cells (gamma cells) |
| Cardiac specific promoters | | |
| Myh6 (aMHC) | Myosin, heavy chain 6, cardiac muscle, alpha | Late differentiation marker of cardiac muscle cells (atrial specificity) |
| MYL2 (MLC-2v) | Myosin, light chain 2, regulatory, cardiac, slow | Late differentiation marker of cardiac muscle cells (ventricular specificity) |
| ITNN13 (cTnl) | Troponin I type 3 (cardiac) | Cardiomyocytes (from immature state) |
| ITNN13 (cTnl) | Troponin I type 3 (cardiac) | Cardiomyocytes (from immature state) |
| NPPA (ANF) | Natriuretic peptide precursor A (also named Atrial Natriuretic Factor) | Atrial specificity in adult cells |
| Slc8a1 (Ncx1) | Solute carrier family 8 (sodium/calcium exchanger), member 1 | Cardiomyocytes from early developmental stages |
| CNS specific promoters | | |
| SYN1 (hSyn) | Synapsin I | Neurons |
| GFAP | Glial fibrillary acidic protein | Astrocytes |
| INA | Internexin neuronal intermediate filament protein, alpha (a-internexin) | Neuroprogenitors |
| NES | Nestin | Neuroprogenitors and ectoderm |
| MOBP | Myelin-associated oligodendrocyte basic protein | Oligodendrocytes |
| MBP | Myelin basic protein | Oligodendrocytes |
| TH | Tyrosine hydroxylase | Dopaminergic neurons |
| FOXA2 (HNF3 beta) | Forkhead box A2 | Dopaminergic neurons (also used as a marker of endoderm) |
| Skin specific promoters | | |
| FLG | Filaggrin | Keratinocytes from granular layer |
| K14 | Keratin 14 | Keratinocytes from granular and basal layers |
| TGM3 | Transglutaminase 3 | Keratinocytes from granular layer |
| Immune cell specific promoters | | |
| ITGAM (CD11B) | Integrin, alpha M (complement component 3 receptor 3 subunit) | Monocytes, macrophages, granulocytes, natural killer cells |
| Urogential cell specific promoters | | |
| Pbsn | Probasin | Prostatic epithelium |
| Upk2 | Uroplakin 2 | Bladder |
| Sbp | Spermine binding protein | Prostate |
| Ferl14 | Fer-1-like 4 | Bladder |
| Endothelial cell specific promoters | | |
| ENG | Endoglin | Endothelial cells |
| Pluripotent and embryonic cell specific promoters | | |
| Oct4 (POU5F1) | POU class 5 homeobox 1 | Pluripotent cells (germ cells, ES cells, iPS cells) |
| NANOG | Nanog homeobox | Pluripotent cells (ES cells, iPS cells) |

TABLE 17-continued

| Additional exemplary cell or tissue-specific promoters | | |
|---|---|---|
| Promoter | Gene Description | Gene Specificity |
| Synthetic Oct4 | Synthetic promoter based on a Oct-4 core enhancer element | Pluripotent cells (ES cells, iPS cells) |
| T brachyury | Brachyury | Mesoderm |
| NES | Nestin | Neuroprogenitors and Ectoderm |
| SOX17 | SRY (sex determining region Y)-box 17 | Endoderm |
| FOXA2 (HNFJ beta) | Forkhead box A2 | Endoderm (also used as a marker of dopaminergic neurons) |
| MIR122 | MicroRNA 122 | Endoderm and hepatocytes (from early stage embryonic liver cells~ |

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology,* 153:516-544; incorporated herein by reference in its entirety).

In some embodiments, a nucleic acid encoding a gene modifying protein or template nucleic acid is operably linked to a control element, e.g., a transcriptional control element, such as a promoter. The transcriptional control element may, in some embodiment, be functional in either a eukaryotic cell, e.g., a mammalian cell; or a prokaryotic cell (e.g., bacterial or archaeal cell). In some embodiments, a nucleotide sequence encoding a polypeptide is operably linked to multiple control elements, e.g., that allow expression of the nucleotide sequence encoding the polypeptide in both prokaryotic and eukaryotic cells.

For illustration purposes, examples of spatially restricted promoters include, but are not limited to, neuron-specific promoters, adipocyte-specific promoters, cardiomyocyte-specific promoters, smooth muscle-specific promoters, photoreceptor-specific promoters, etc. Neuron-specific spatially restricted promoters include, but are not limited to, a neuron-specific enolase (NSE) promoter (see, EMBL HSENO2, X51956); an aromatic amino acid decarboxylase (AADC) promoter, a neurofilament promoter (see, e.g., GenBank HUMNFL, L04147); a synapsin promoter (see, e.g., GenBank HUMSYNIB, M55301); a thy-1 promoter (see, e.g., Chen et al. (1987) Cell 51:7-19; and Llewellyn, et al. (2010) Nat. Med. 16(10):1161-1166); a serotonin receptor promoter (see, e.g., GenBank S62283); a tyrosine hydroxylase promoter (TH) (see, e.g., Oh et al. (2009) Gene Ther 16:437; Sasaoka et at (1992) Mol. Brain Res. 16:274; Boundy et al. (1998) J. Neurosci. 18:9989; and Kaneda et al. (1991) Neuron 6:583-594); a GnRH promoter (see, e.g., Radovick et al. (1991) Proc. Natl. Acad. Sci. USA 88:3402-3406); an L7 promoter (see, e.g., Oberdick et al. (1990) Science 248:223-226); a DNMT promoter (see, e.g., Bartge et al. (1988) Proc. Natl. Acad. Sci. USA 85:3648-3652); Ern enkephalin promoter (see, e.g., Comb et al. (1988) EMBO J. 117:3793-3805); a myelin basic protein (MBP) promoter; a Ca2+-calmodulin-dependent protein kinase II-alpha (CamKIIα) promoter (see, e.g., Mayford et al. (1996) Proc. Natl. Acad. Sci. USA 93:13250; and Casanova et al. (2001) Genesis 31:37); a CMV enhancer/platelet-derived growth factor-β promoter (see, e.g., Liu et al. (2004) Gene Therapy 11:52-60); and the like.

Adipocyte-specific spatially restricted promoters include, but are not limited to, the aP2 gene promoter/enhancer, e.g., a region from −5.4 kb to +21 bp of a human aP2 gene (see, e.g., Tozzo et al. (1997) Endocrinol. 138:1604; Ross et al. (1990) Proc. Natl. Acad. Sci. USA 87:9590; and Pavjani et al. (2005) Nat. Med. 11:797); a glucose transporter-4 (GLUT4) promoter (see, e.g., Knight et al. (2003) Proc. Natl. Acad. Sci. USA 100:14725); a fatty acid translocase (FAT/CD36) promoter (see, e.g., Kuriki et al. (2002) Biol. Pharm. Bull. 25:1476; and Sato et al. (2002) J. Biol. Chem. 277:15703); a stearoyl-CoA desaturase-1 (SCD1) promoter (Libor et al. (1999) J. Biol. Chem. 274:20603); a leptin promoter (see, e.g., Mason et al. (1998) Endocrinol. 139: 1013; and Chen et al. (1999) Biochem. Biophys. Res. Comm. 262:187); an adiponectin promoter (see, e.g., Kita et al. (2005) Biochem. Biophys. Res. Comm. 331:484; and Chakrabarti (2010) Endocrinol. 151:2408); an adipsin promoter (see, e.g., Platt et al. (1989) Proc. Natl. Acad. Sci. USA 86:7490); a resistin promoter (see, e.g., Seo et al. (2003) Molec. Endocrinol. 17:1522); and the like.

Cardiomyocyte-specific spatially restricted promoters include, but are not limited to, control sequences derived from the following genes: myosin light chain-2, α-myosin heavy chain, AE3, cardiac troponin C, cardiac actin, and the like. Franz et al. (1997) Cardiovasc. Res. 35:560-566; Robbins et al. (1995) Ann. N.Y. Acad. Sci. 752:492-50:5; Linn et al. (1995) Circ. Res. 76:584-591; Parmacek et al. (1994) Mol. Cell. Biol. 14:1870-1885; Hunter et al. (1993) Hypertension 22:608-617; and Sartoreili et al. (1992) Proc. Natl. Acad. Sci. USA 89:4047-4051.

Smooth muscle-specific spatially restricted promoters include, but are not limited to, an SM22α promoter (see, e.g., Akyürek et al. (2000) Mol. Med. 6:983; and U.S. Pat. No. 7,169,874); a smoothelin promoter (see, e.g., WO2001/018048); an α-smooth muscle actin promoter; and the like. For example, a 0.4 kb region of the SM22α promoter, within which lie two CArG elements, has been shown to mediate vascular smooth muscle cell-specific expression (see, e.g., Kim, et al. (1997) Mol. Cell. Biol. 17, 2266-2278; Li, et al., (1996) J. Cell Biol. 132, 849-859; and Moessler, et al. (1996) Development 122, 2415-2425).

Photoreceptor-specific spatially restricted promoters include, but are not limited to, a rhodopsin promoter; a rhodopsin kinase promoter (Young et al. (2003) Ophthalmol. Via. Sci. 44:4076); a beta phosphodiesterase gene promoter (Nicoud et at (2007) J. Gene Med. 9:1015); a retinitis pigmentosa gene promoter (Nicoud et al. (2007) supra); an interphotoreceptor retinoid-binding protein (IMP) gene enhancer (Nicoud et al. (2007) supra); an IRBP gene promoter (Yokoyama et al. (1992) Exp Eye Res. 55:225); and the like.

In some embodiments, a gene modifying system, e.g., DNA encoding a gene modifying polypeptide, DNA encoding a template RNA, or DNA or RNA encoding a heterologous object sequence, is designed such that one or more elements is operably linked to a tissue-specific promoter, e.g., a promoter that is active in T-cells. In further embodiments, the T-cell active promoter is inactive in other cell types, e.g., B-cells, NK cells. In some embodiments, the T-cell active promoter is derived from a promoter for a gene encoding a component of the T-cell receptor, e.g., TRAC, TRBC, TRGC, TRDC. In some embodiments, the T-cell active promoter is derived from a promoter for a gene encoding a component of a T-cell-specific cluster of differentiation protein, e.g., CD3, e.g., CD3D, CD3E, CD3G, CD3Z. In some embodiments, T-cell-specific promoters in gene modifying systems are discovered by comparing publicly available gene expression data across cell types and selecting promoters from the genes with enhanced expression in T-cells. In some embodiments, promoters may be selecting depending on the desired expression breadth, e.g., promoters that are active in T-cells only, promoters that are active in NK cells only, promoters that are active in both T-cells and NK cells.

Cell-specific promoters known in the art may be used to direct expression of a gene modifying protein, e.g., as described herein. Nonlimiting exemplary mammalian cell-specific promoters have been characterized and used in mice expressing Cre recombinase in a cell-specific manner. Certain nonlimiting exemplary mammalian cell-specific promoters are listed in Table 1 of U.S. Pat. No. 9,845,481, incorporated herein by reference.

In some embodiments, a vector as described herein comprises an expression cassette. Typically, an expression cassette comprises the nucleic acid molecule of the instant invention operatively linked to a promoter sequence. For example, a promoter is operatively linked with a coding sequence when it is capable of affecting the expression of that coding sequence (e.g., the coding sequence is under the transcriptional control of the promoter). Encoding sequences can be operatively linked to regulatory sequences in sense or antisense orientation. In certain embodiments, the promoter is a heterologous promoter. In certain embodiments, an expression cassette may comprise additional elements, for example, an intron, an enhancer, a polyadenylation site, a woodchuck response element (WRE), and/or other elements known to affect expression levels of the encoding sequence. A promoter typically controls the expression of a coding sequence or functional RNA. In certain embodiments, a promoter sequence comprises proximal and more distal upstream elements and can further comprise an enhancer element. An enhancer can typically stimulate promoter activity and may be an innate element of the promoter or a heterologous element inserted to enhance the level or tissue-specificity of a promoter. In certain embodiments, the promoter is derived in its entirety from a native gene. In certain embodiments, the promoter is composed of different elements derived from different naturally occurring promoters. In certain embodiments, the promoter comprises a synthetic nucleotide sequence. It will be understood by those skilled in the art that different promoters will direct the expression of a gene in different tissues or cell types, or at different stages of development, or in response to different environmental conditions or to the presence or the absence of a drug or transcriptional co-factor. Ubiquitous, cell-type-specific, tissue-specific, developmental stage-specific, and conditional promoters, for example, drug-responsive promoters (e.g., tetracycline-responsive promoters) are well known to those of skill in the art. Exemplary promoters include, but are not limited to, the phosphoglycerate kinase (PKG) promoter, CAG (composite of the CMV enhancer the chicken beta actin promoter (CBA) and the rabbit beta globin intron), NSF (neuronal specific enolase), synapsin or NeuN promoters, the SV40 early promoter, mouse mammary tumor virus LTR promoter; adenovirus major late promoter (Ad MLP), a herpes simplex virus (HSV) promoter, a cytomegalovirus (CMV) promoter such as the CMV immediate early promoter region (CMVIE), SFFV promoter, rous sarcoma virus (RSV) promoter, synthetic promoters, hybrid promoters, and the like. Other promoters can be of human origin or from other species, including from mice. Common promoters include, e.g., the human cytomegalovirus (CMV) immediate early gene promoter, the SV40 early promoter, the Rous sarcoma virus long terminal repeat, [beta]-actin, rat insulin promoter, the phosphoglycerate kinase promoter, the human alpha-1 antitrypsin (hAAT) promoter, the transthyretin promoter, the TBG promoter and other liver-specific promoters, the desmin promoter and similar muscle-specific promoters, the EF1-alpha promoter, hybrid promoters with multi-tissue specificity, promoters specific for neurons like synapsin and glyceraldehyde-3-phosphate dehydrogenase promoter, all of which are promoters well known and readily available to those of skill in the art, can be used to obtain high-level expression of the coding sequence of interest. In addition, sequences derived from non-viral genes, such as the murine metallothionein gene, will also find use herein. Such promoter sequences are commercially available from, e.g., Stratagene (San Diego, CA). Additional exemplary promoter sequences are described, for example, in WO2018213786A1 (incorporated by reference herein in its entirety).

In some embodiments, the apolipoprotein E enhancer (ApoE) or a functional fragment thereof is used, e.g., to drive expression in the liver. In some embodiments, two copies of the ApoE enhancer or a functional fragment thereof are used. In some embodiments, the ApoE enhancer or functional fragment thereof is used in combination with a promoter, e.g., the human alpha-1 antitrypsin (hAAT) promoter.

In some embodiments, the regulatory sequences impart tissue-specific gene expression capabilities. In some cases, the tissue-specific regulatory sequences bind tissue-specific transcription factors that induce transcription in a tissue specific manner. Various tissue-specific regulatory sequences (e.g., promoters, enhancers, etc.) are known in the art. Exemplary tissue-specific regulatory sequences include, but are not limited to, the following tissue-specific promoters: a liver-specific thyroxin binding globulin (TBG) promoter, a insulin promoter, a glucagon promoter, a somatostatin promoter, a pancreatic polypeptide (PPY) promoter, a synapsin-1 (Syn) promoter, a creatine kinase (MCK) promoter, a mammalian desmin (DES) promoter, a α-myosin heavy chain (α-MHC) promoter, or a cardiac Troponin (cTnT) promoter. Other exemplary promoters include Beta-actin promoter, hepatitis B virus core promoter, Sandig et al., Gene Ther., 3:1002-9 (1996); alpha-fetoprotein (AFP) promoter, Arbuthnot et al., Hum. Gene Ther., 7:1503-14 (1996)), bone osteocalcin promoter (Stein et al., Mol. Biol. Rep., 241185-96 (1997)); bone sialoprotein promoter (Chen et al., J. Bone Miner. Res., 11:654-64 (1996)), CD2 promoter (Hansal et al., J. Immunol., 161:1063-8 (1998); immunoglobulin heavy chain promoter; T cell receptor α-chain promoter, neuronal such as neuron-specific enolase (NSE) promoter (Andersen et al., Cell. Mol. Neurobiol., 13:503-15 (1993)), neurofilament light-chain gene promoter (Piccioli et al., Proc. Natl. Acad. Sci. USA, 88:5611-5 (1991)), and the neuron-specific vgf gene promoter (Piccioli et al., Neuron, 15:373-84 (1995)), and others. Additional exemplary promoter sequences are described, for example, in U.S. Pat. No. 10,300,146 (incorporated herein by reference in its entirety). In some embodiments, a tissue-specific regulatory element, e.g., a tissue-specific promoter, is selected from one known to be operably linked to a gene that is highly expressed in a given tissue, e.g., as measured by RNA-seq or protein expression data, or a combination thereof. Methods for analyzing tissue specificity by expression are taught in Fagerberg et al. *Mol Cell Proteomics* 13(2):397-406 (2014), which is incorporated herein by reference in its entirety.

In some embodiments, a vector described herein is a multicistronic expression construct. Multicistronic expression constructs include, for example, constructs harboring a first expression cassette, e.g. comprising a first promoter and a first encoding nucleic acid sequence, and a second expression cassette, e.g. comprising a second promoter and a second encoding nucleic acid sequence. Such multicistronic expression constructs may, in some instances, be particularly useful in the delivery of non-translated gene products, such as hairpin RNAs, together with a polypeptide, for example, a gene modifying polypeptide and gene modifying template. In some embodiments, multicistronic expression constructs may exhibit reduced expression levels of one or more of the included transgenes, for example, because of promoter interference or the presence of incompatible nucleic acid elements in close proximity. If a multicistronic expression construct is part of a viral vector, the presence of a self-complementary nucleic acid sequence may, in some instances, interfere with the formation of structures necessary for viral reproduction or packaging.

In some embodiments, the sequence encodes an RNA with a hairpin. In some embodiments, the hairpin RNA is a guide RNA, a template RNA, a shRNA, or a microRNA. In some embodiments, the first promoter is an RNA polymerase I promoter. In some embodiments, the first promoter is an RNA polymerase II promoter. In some embodiments, the second promoter is an RNA polymerase III promoter. In some embodiments, the second promoter is a U6 or H1 promoter.

Without wishing to be bound by theory, multicistronic expression constructs may not achieve optimal expression levels as compared to expression systems containing only one cistron. One of the suggested causes of lower expression levels achieved with multicistronic expression constructs comprising two or more promoter elements is the phenomenon of promoter interference (see, e.g., Curtin J A, Dane A P, Swanson A, Alexander I E, Ginn S L. *Bidirectional promoter interference between two widely used internal heterologous promoters in a late-generation lentiviral construct*. Gene Ther. 2008 March; 15(5):384-90; and Martin-Duque P, Jezzard S, Kaftansis L, Vassaux G. *Direct comparison of the insulating properties of two genetic elements in an adenoviral vector containing two different expression cassettes*. Hum Gene Ther. 2004 October; 15(10):995-1002; both references incorporated herein by reference for disclosure of promoter interference phenomenon. In some embodiments, the problem of promoter interference may be overcome, e.g., by producing multicistronic expression constructs comprising only one promoter driving transcription of multiple encoding nucleic acid sequences separated by internal ribosomal entry sites, or by separating cistrons comprising their own promoter with transcriptional insulator elements. In some embodiments, single-promoter driven expression of multiple cistrons may result in uneven expression levels of the cistrons. In some embodiments, a promoter cannot efficiently be isolated and isolation elements may not be compatible with some gene transfer vectors, for example, some retroviral vectors.

MicroRNAs

MicroRNAs (miRNAs) and other small interfering nucleic acids generally regulate gene expression via target RNA transcript cleavage/degradation or translational repression of the target messenger RNA (mRNA). miRNAs may, in some instances, be natively expressed, typically as final 19-25 non-translated RNA products. miRNAs generally exhibit their activity through sequence-specific interactions with the 3' untranslated regions (UTR) of target mRNAs. These endogenously expressed miRNAs may form hairpin precursors that are subsequently processed into an miRNA duplex, and further into a mature single stranded miRNA molecule This mature miRNA generally guides a muitiprotein complex, miRISC, which identifies target 3' UTR regions of target mRNAs based upon their complementarity to the mature miRNA. Useful transgene products may include, for example, miRNAs or miRNA binding sites that regulate the expression of a linked polypeptide. A non-limiting list of miRNA genes; the products of these genes and their homologues are useful as transgenes or as targets for small interfering nucleic acids (e.g., miRNA sponges, antisense oligonucleotides), e.g., in methods such as those listed in U.S. Ser. No. 10/300,146, 22:25-25:48, are herein incorporated by reference. In some embodiments, one or more binding sites for one or more of the foregoing miRNAs are incorporated in a transgene, e.g., a transgene delivered by a rAAV vector, e.g., to inhibit the expression of the transgene in one or more tissues of an animal harboring the transgene. In some embodiments, a binding site may be selected to control the expression of a transgene in a tissue specific manner. For example, binding sites for the liver-specific miR-122 may be incorporated into a transgene to inhibit expression of that transgene in the liver. Additional exemplary miRNA sequences are described, for example, in U.S. Pat. No. 10,300,146 (incorporated herein by reference in its entirety).

An miR inhibitor or miRNA inhibitor is generally an agent that blocks miRNA expression and/or processing. Examples of such agents include, but are not limited to, microRNA antagonists, microRNA specific antisense, microRNA sponges, and microRNA oligonucleotides (double-stranded, hairpin, short oligonucleotides) that inhibit miRNA, interaction with a Drosha complex. MicroRNA inhibitors, e.g., miRNA sponges, can be expressed in cells from transgenes (e.g., as described in Ebert, M. S. Nature Methods, Epub Aug. 12, 2007; incorporated by reference herein in its entirety). In some embodiments, microRNA sponges, or other miR inhibitors, are used with the AAVs. microRNA sponges generally specifically inhibit miRNAs through a complementary heptameric seed sequence. In some embodiments, an entire family of miRNAs can be silenced using a single sponge sequence. Other methods for silencing miRNA function (derepression of miRNA targets) in cells will be apparent to one of ordinary skill in the art.

In some embodiments, a gene modifying system, template RNA, or polypeptide described herein is administered to or is active in (e.g., is more active in) a target tissue, e.g., a first tissue. In some embodiments, the gene modifying system, template RNA, or polypeptide is not administered to or is less active in (e.g., not active in) a non-target tissue. In some embodiments, a gene modifying system, template RNA, or polypeptide described herein is useful for modifying DNA in a target tissue, e.g., a first tissue, (e.g., and not modifying DNA in a non-target tissue).

In some embodiments, a gene modifying system comprises (a) a polypeptide described herein or a nucleic acid encoding the same, (b) a template nucleic acid (e.g., template RNA) described herein, and (c) one or more first tissue-specific expression-control sequences specific to the target tissue, wherein the one or more first tissue-specific expression-control sequences specific to the target tissue are in operative association with (a), (b), or (a) and (b), wherein, when associated with (a), (a) comprises a nucleic acid encoding the polypeptide.

In some embodiments, the nucleic acid in (b) comprises RNA.

In some embodiments, the nucleic acid in (b) comprises DNA.

In some embodiments, the nucleic acid in (b): (i) is single-stranded or comprises a single-stranded segment, e.g., is single-stranded DNA or comprises a single-stranded segment and one or more double stranded segments; (ii) has inverted terminal repeats; or (iii) both (i) and (ii).

In some embodiments, the nucleic acid in (b) is double-stranded or comprises a double-stranded segment.

In some embodiments, (a) comprises a nucleic acid encoding the polypeptide.

In some embodiments, the nucleic acid in (a) comprises RNA.

In some embodiments, the nucleic acid in (a) comprises DNA.

In some embodiments, the nucleic acid in (a): (i) is single-stranded or comprises a single-stranded segment, e.g., is single-stranded DNA or comprises a single-stranded segment and one or more double stranded segments; (ii) has inverted terminal repeats; or (iii) both (i) and (ii).

In some embodiments, the nucleic acid in (a) is double-stranded or comprises a double-stranded segment.

In some embodiments, the nucleic acid in (a), (b), or (a) and (b) is linear.

In some embodiments, the nucleic acid in (a), (b), or (a) and (b) is circular, e.g., a plasmid or minicircle.

In some embodiments, the heterologous object sequence is in operative association with a first promoter.

In some embodiments, the one or more first tissue-specific expression-control sequences comprises a tissue specific promoter.

In some embodiments, the tissue-specific promoter comprises a first promoter in operative association with: (i) the heterologous object sequence, (ii) a nucleic acid encoding the retroviral RT, or (iii) (i) and (ii).

In some embodiments, the one or more first tissue-specific expression-control sequences comprises a tissue-specific microRNA recognition sequence in operative association with: (i) the heterologous object sequence, (ii) a nucleic acid encoding the retroviral RT domain, or (iii) (i) and (ii).

In some embodiments, a system comprises a tissue-specific promoter, and the system further comprises one or more tissue-specific microRNA recognition sequences, wherein: (i) the tissue specific promoter is in operative association with: (I) the heterologous object sequence, (II) a nucleic acid encoding the retroviral RT domain, or (III) (I) and (II); and/or (ii) the one or more tissue-specific microRNA recognition sequences are in operative association with: (I) the heterologous object sequence, (II) a nucleic acid encoding the retroviral RT, or (III) (I) and (II).

In some embodiments, wherein (a) comprises a nucleic acid encoding the polypeptide, the nucleic acid comprises a promoter in operative association with the nucleic acid encoding the polypeptide.

In some embodiments, the nucleic acid encoding the polypeptide comprises one or more second tissue-specific expression-control sequences specific to the target tissue in operative association with the polypeptide coding sequence.

In some embodiments, the one or more second tissue-specific expression-control sequences comprises a tissue specific promoter.

In some embodiments, the tissue-specific promoter is the promoter in operative association with the nucleic acid encoding the polypeptide.

In some embodiments, the one or more second tissue-specific expression-control sequences comprises a tissue-specific microRNA recognition sequence.

In some embodiments, the promoter in operative association with the nucleic acid encoding the polypeptide is a tissue-specific promoter, the system further comprising one or more tissue-specific microRNA recognition sequences.

In some embodiments, a nucleic acid component of a system provided by the invention is a sequence (e.g., encoding the polypeptide or comprising a heterologous object sequence) flanked by untranslated regions (UTRs) that modify protein expression levels. Various 5' and 3' UTRs can affect protein expression. For example, in some embodiments, the coding sequence may be preceded by a 5' UTR that modifies RNA stability or protein translation. In some embodiments, the sequence may be followed by a 3' UTR that modifies RNA stability or translation. In some embodiments, the sequence may be preceded by a 5' UTR and followed by a 3' UTR that modify RNA stability or translation. In some embodiments, the 5' and/or 3' UTR may be selected from the 5' and 3' UTRs of complement factor 3 (C3) (CACTCCTCCCCATCCTCTCCCTCTGTCCCTCTGTCCCTCTGACCCTGCACTGTCCCAG CACC; SEQ ID NO: 11,004) or orosomucoid 1 (ORM1) (CAGGACACAGCCTTGGATCAGGACAGAGACTTGGGGGCCATCCTGCCCCTCCAACC CGACATGTGTACCTCAGCTTTTTCCCTCACTTGCATCAATAAAGCTTCTGTGTTTGGA ACAGCTAA; SEQ ID NO: 11,005) (Asrani et al. RNA Biology 2018). In certain embodiments, the 5' UTR is the 5' UTR from C3 and the 3' UTR is the 3' UTR from ORM1. In certain embodiments, a 5' UTR and 3' UTR for protein expression, e.g., mRNA (or DNA encoding the RNA) for a gene modifying polypeptide or heterologous object sequence, comprise optimized expression sequences. In some embodiments, the 5' UTR comprises GGGAAAUAAGAGAGAAAAGAAGAGUAAGAAGAAAUAUAAGAGCCACC (SEQ ID NO: 11,006) and/or the 3' UTR comprising UGAUAAUAGGCUGGAGCCUCGGUGGCCAUGCUUCUUGCCCCUUGGGCCUCCCCCC AGCCCCUCCUCCCCUUCCUGCACCCGUACCCCCGUGGUCUUUGAAUAAAGUCUGA (SEQ ID NO: 11,007), e.g., as described in Richner et al. *Cell* 168(6): P1114-1125 (2017), the sequences of which are incorporated herein by reference. In some embodiments, a 5' and/or 3' UTR may be selected to enhance protein expression. In some embodiments, a 5' and/or 3' UTR may be selected to modify protein expression such that overproduction inhibition is minimized. In some embodiments, UTRs are around a coding sequence, e.g., outside the coding sequence and in other embodiments proximal to the coding sequence. In some embodiments, additional regulatory elements (e.g., miRNA binding sites, cis-regulatory sites) are included in the UTRs.

In some embodiments, an open reading frame of a gene modifying system, e.g., an ORF of an mRNA (or DNA encoding an mRNA) encoding a gene modifying polypeptide or one or more ORFs of an mRNA (or DNA encoding an mRNA) of a heterologous object sequence, is flanked by a 5' and/or 3' untranslated region (UTR) that enhances the expression thereof. In some embodiments, the 5' UTR of an mRNA component (or transcript produced from a DNA component) of the system comprises the sequence 5'-GGGAAAUAAGAGAGAAAAGAAGAGUAAGAAGAAAUAUAAGAGCCACC-3'; SEQ ID NO: 11,008). In some embodiments, the 3' UTR of an mRNA component (or transcript produced from a DNA component) of the system comprises the sequence 5'-UGAUAAUAGGCUGGAGCCUCGGUGGCCAUGCUUCUUGCCCCUUGGGCCUCCCCCC AGCCCCUCCUCCCCUUCCUGCACCCGUACCCCCGUGGUCUUUGAAUAAAGUCUGA-3' (SEQ ID NO: 11,009). This combination of 5' UTR and 3' UTR has been shown to result in desirable expression of an operably linked ORF by Richner et al. *Cell* 168(6): P1114-1125 (2017), the teachings and sequences of which are incorporated herein by reference. In some embodiments, a system described herein comprises a DNA encoding a transcript, wherein the DNA comprises the corresponding 5' UTR and 3' UTR sequences, with T substituting for U in the above-listed sequence). In some embodiments, a DNA vector used to produce an RNA component of the system further comprises a promoter upstream of the 5' UTR for initiating in vitro transcription, e.g, a T7, T3, or SP6 promoter. The 5' UTR above begins with GGG, which is a suitable start for optimizing transcription using T7 RNA polymerase. For tuning transcription levels and altering the transcription start site nucleotides to fit alternative 5' UTRs, the teachings of Davidson et al. *Pac Symp Biocomput* 433-443 (2010) describe T7 promoter variants, and the methods of discovery thereof, that fulfill both of these traits.

Viral Vectors and Components Thereof

Viruses are a useful source of delivery vehicles for the systems described herein, in addition to a source of relevant enzymes or domains as described herein, e.g., as sources of polymerases and polymerase functions used herein, e.g., DNA-dependent DNA polymerase, RNA-dependent RNA polymerase, RNA-dependent DNA polymerase, DNA-dependent RNA polymerase, reverse transcriptase. Some enzymes, e.g., reverse transcriptases, may have multiple activities, e.g., be capable of both RNA-dependent DNA polymerization and DNA-dependent DNA polymerization, e.g., first and second strand synthesis. In some embodiments, the virus used as a gene modifying delivery system or a source of components thereof may be selected from a group as described by Baltimore *Bacteriol Rev* 35(3):235-241 (1971).

In some embodiments, the virus is selected from a Group I virus, e.g., is a DNA virus and packages dsDNA into virions. In some embodiments, the Group I virus is selected from, e.g., Adenoviruses, Herpesviruses, Poxviruses.

In some embodiments, the virus is selected from a Group II virus, e.g., is a DNA virus and packages ssDNA into virions. In some embodiments, the Group II virus is selected from, e.g., Parvoviruses. In some embodiments, the parvovirus is a dependoparvovirus, e.g., an adeno-associated virus (AAV).

In some embodiments, the virus is selected from a Group III virus, e.g., is an RNA virus and packages dsRNA into virions. In some embodiments, the Group III virus is selected from, e.g., Reoviruses. In some embodiments, one or both strands of the dsRNA contained in such virions is a coding molecule able to serve directly as mRNA upon transduction into a host cell, e.g., can be directly translated into protein upon transduction into a host cell without requiring any intervening nucleic acid replication or polymerization steps.

In some embodiments, the virus is selected from a Group IV virus, e.g., is an RNA virus and packages ssRNA(+) into virions. In some embodiments, the Group IV virus is selected from, e.g., Coronaviruses, Picornaviruses, Togaviruses. In some embodiments, the ssRNA(+) contained in such virions is a coding molecule able to serve directly as mRNA upon transduction into a host cell, e.g., can be directly translated into protein upon transduction into a host cell without requiring any intervening nucleic acid replication or polymerization steps.

In some embodiments, the virus is selected from a Group V virus, e.g., is an RNA virus and packages ssRNA(−) into virions. In some embodiments, the Group V virus is selected from, e.g., Orthomyxoviruses, Rhabdoviruses. In some embodiments, an RNA virus with an ssRNA(−) genome also carries an enzyme inside the virion that is transduced to host cells with the viral genome, e.g., an RNA-dependent RNA polymerase, capable of copying the ssRNA(−) into ssRNA (+) that can be translated directly by the host.

In some embodiments, the virus is selected from a Group VI virus, e.g., is a retrovirus and packages ssRNA(+) into virions. In some embodiments, the Group VI virus is selected from, e.g., retroviruses. In some embodiments, the retrovirus is a lentivirus, e.g., HIV-1, HIV-2, SIV, BIV. In some embodiments, the retrovirus is a spumavirus, e.g., a foamy virus, e.g., HFV, SFV, BFV. In some embodiments, the ssRNA(+) contained in such virions is a coding molecule able to serve directly as mRNA upon transduction into a host cell, e.g., can be directly translated into protein upon transduction into a host cell without requiring any intervening nucleic acid replication or polymerization steps. In some embodiments, the ssRNA(+) is first reverse transcribed and copied to generate a dsDNA genome intermediate from which mRNA can be transcribed in the host cell. In some embodiments, an RNA virus with an ssRNA(+) genome also carries an enzyme inside the virion that is transduced to host cells with the viral genome, e.g., an RNA-dependent DNA polymerase, capable of copying the ssRNA(+) into dsDNA that can be transcribed into mRNA and translated by the host. In some embodiments, the reverse transcriptase from a Group VI retrovirus is incorporated as the reverse transcriptase domain of a gene modifying polypeptide.

In some embodiments, the virus is selected from a Group VII virus, e.g., is a retrovirus and packages dsRNA into virions. In some embodiments, the Group VII virus is selected from, e.g., Hepadnaviruses. In some embodiments, one or both strands of the dsRNA contained in such virions is a coding molecule able to serve directly as mRNA upon transduction into a host cell, e.g., can be directly translated into protein upon transduction into a host cell without requiring any intervening nucleic acid replication or polymerization steps. In some embodiments, one or both strands of the dsRNA contained in such virions is first reverse transcribed and copied to generate a dsDNA genome intermediate from which mRNA can be transcribed in the host cell. In some embodiments, an RNA virus with a dsRNA genome also carries an enzyme inside the virion that is transduced to host cells with the viral genome, e.g., an RNA-dependent DNA polymerase, capable of copying the dsRNA into dsDNA that can be transcribed into mRNA and translated by the host. In some embodiments, the reverse transcriptase from a Group VII retrovirus is incorporated as the reverse transcriptase domain of a gene modifying polypeptide.

In some embodiments, virions used to deliver nucleic acid in this invention may also carry enzymes involved in the process of gene modification. For example, a retroviral virion may contain a reverse transcriptase domain that is delivered into a host cell along with the nucleic acid. In some embodiments, an RNA template may be associated with a gene modifying polypeptide within a virion, such that both are co-delivered to a target cell upon transduction of the nucleic acid from the viral particle. In some embodiments, the nucleic acid in a virion may comprise DNA, e.g., linear ssDNA, linear dsDNA, circular ssDNA, circular dsDNA, minicircle DNA, dbDNA, ceDNA. In some embodiments, the nucleic acid in a virion may comprise RNA, e.g., linear ssRNA, linear dsRNA, circular ssRNA, circular dsRNA. In some embodiments, a viral genome may circularize upon transduction into a host cell, e.g., a linear ssRNA molecule may undergo a covalent linkage to form a circular ssRNA, a linear dsRNA molecule may undergo a covalent linkage to form a circular dsRNA or one or more circular ssRNA. In some embodiments, a viral genome may replicate by rolling circle replication in a host cell. In some embodiments, a viral genome may comprise a single nucleic acid molecule, e.g., comprise a non-segmented genome. In some embodiments, a viral genome may comprise two or more nucleic acid molecules, e.g., comprise a segmented genome. In some embodiments, a nucleic acid in a virion may be associated with one or proteins. In some embodiments, one or more proteins in a virion may be delivered to a host cell upon transduction. In some embodiments, a natural virus may be adapted for nucleic acid delivery by the addition of virion packaging signals to the target nucleic acid, wherein a host cell is used to package the target nucleic acid containing the packaging signals.

In some embodiments, a virion used as a delivery vehicle may comprise a commensal human virus. In some embodiments, a virion used as a delivery vehicle may comprise an anellovirus, the use of which is described in WO2018232017A1, which is incorporated herein by reference in its entirety.

AAV Administration

In some embodiments, an adeno-associated virus (AAV) is used in conjunction with the system, template nucleic acid, and/or polypeptide described herein. In some embodiments, an AAV is used to deliver, administer, or package the system, template nucleic acid, and/or polypeptide described herein. In some embodiments, the AAV is a recombinant AAV (rAAV).

In some embodiments, a system comprises (a) a polypeptide described herein or a nucleic acid encoding the same, (b) a template nucleic acid (e.g., template RNA) described herein, and (c) one or more first tissue-specific expression-control sequences specific to the target tissue, wherein the one or more first tissue-specific expression-control sequences specific to the target tissue are in operative association with (a), (b), or (a) and (b), wherein, when associated with (a), (a) comprises a nucleic acid encoding the polypeptide.

In some embodiments, a system described herein further comprises a first recombinant adeno-associated virus (rAAV) capsid protein; wherein the at least one of (a) or (b) is associated with the first rAAV capsid protein, wherein at least one of (a) or (b) is flanked by AAV inverted terminal repeats (ITRs).

In some embodiments, (a) and (b) are associated with the first rAAV capsid protein.

In some embodiments, (a) and (b) are on a single nucleic acid.

In some embodiments, the system further comprises a second rAAV capsid protein, wherein at least one of (a) or (b) is associated with the second rAAV capsid protein, and wherein the at least one of (a) or (b) associated with the second rAAV capsid protein is different from the at least one of (a) or (b) is associated with the first rAAV capsid protein.

In some embodiments, the at least one of (a) or (b) is associated with the first or second rAAV capsid protein is dispersed in the interior of the first or second rAAV capsid protein, which first or second rAAV capsid protein is in the form of an AAV capsid particle.

In some embodiments, the system further comprises a nanoparticle, wherein the nanoparticle is associated with at least one of (a) or (b).

In some embodiments, (a) and (b), respectively are associated with: a) a first rAAV capsid protein and a second rAAV capsid protein; b) a nanoparticle and a first rAAV capsid protein; c) a first rAAV capsid protein; d) a first adenovirus capsid protein; e) a first nanoparticle and a second nanoparticle; or f) a first nanoparticle.

Viral vectors are useful for delivering all or part of a system provided by the invention, e.g., for use in methods provided by the invention. Systems derived from different viruses have been employed for the delivery of polypeptides or nucleic acids; for example: integrase-deficient lentivirus, adenovirus, adeno-associated virus (AAV), herpes simplex virus, and baculovirus (reviewed in Hodge et al. Hum Gene Ther 2017; Narayanavari et al. Crit Rev Biochem Mol Biol 2017; Boehme et al. Curr Gene Ther 2015).

Adenoviruses are common viruses that have been used as gene delivery vehicles given well-defined biology, genetic stability, high transduction efficiency, and ease of large-scale production (see, for example, review by Lee et al. Genes & Diseases 2017). They possess linear dsDNA genomes and come in a variety of serotypes that differ in tissue and cell tropisms. In order to prevent replication of infectious virus in recipient cells, adenovirus genomes used for packaging are deleted of some or all endogenous viral proteins, which are provided in trans in viral production cells. This renders the genomes helper-dependent, meaning they can only be replicated and packaged into viral particles in the presence of the missing components provided by so-called helper functions. A helper-dependent adenovirus system with all viral ORFs removed may be compatible with packaging foreign DNA of up to −37 kb (Parks et al. J Virol 1997). In some embodiments, an adenoviral vector is used to deliver DNA corresponding to the polypeptide or template component of the gene modifying system, or both are contained on separate or the same adenoviral vector. In some embodiments, the adenovirus is a helper-dependent adenovirus (HD-AdV) that is incapable of self-packaging. In some embodiments, the adenovirus is a high-capacity adenovirus (HC-AdV) that has had all or a substantial portion of endogenous viral ORFs deleted, while retaining the necessary sequence components for packaging into adenoviral particles. For this type of vector, the only adenoviral sequences required for genome packaging are noncoding sequences: the inverted terminal repeats (ITRs) at both ends and the packaging signal at the 5'-end (Jager et al. Nat Protoc 2009). In some embodiments, the adenoviral genome also comprises stuffer DNA to meet a minimal genome size for optimal production and stability (see, for example, Hausl et al. Mol Ther 2010). In some embodiments, an adenovirus is used to deliver a gene modifying system to the liver.

In some embodiments, an adenovirus is used to deliver a gene modifying system to HSCs, e.g., HDAd5/35++. HDAd5/35++ is an adenovirus with modified serotype 35 fibers that de-target the vector from the liver (Wang et al. Blood Adv 2019). In some embodiments, the adenovirus that delivers a gene modifying system to HSCs utilizes a receptor that is expressed specifically on primitive HSCs, e.g., CD46.

Adeno-associated viruses (AAV) belong to the parvoviridae family and more specifically constitute the dependoparvovirus genus. The AAV genome is composed of a linear single-stranded DNA molecule which contains approximately 4.7 kilobases (kb) and consists of two major open reading frames (ORFs) encoding the non-structural Rep (replication) and structural Cap (capsid) proteins. A second ORF within the cap gene was identified that encodes the assembly-activating protein (AAP). The DNAs flanking the AAV coding regions are two cis-acting inverted terminal repeat (ITR) sequences, approximately 145 nucleotides in length, with interrupted palindromic sequences that can be folded into energetically stable hairpin structures that function as primers of DNA replication. In addition to their role in DNA replication, the ITR sequences have been shown to be involved in viral DNA integration into the cellular genome, rescue from the host genome or plasmid, and encapsidation of viral nucleic acid into mature virions (Muzyczka, (1992) Curr. Top. Micro. Immunol. 158:97-129). In some embodiments, one or more gene modifying nucleic acid components is flanked by ITRs derived from AAV for viral packaging. See, e.g., WO2019113310.

In some embodiments, one or more components of the gene modifying system are carried via at least one AAV vector. In some embodiments, the at least one AAV vector is selected for tropism to a particular cell, tissue, organism. In some embodiments, the AAV vector is pseudotyped, e.g., AAV2/8, wherein AAV2 describes the design of the construct but the capsid protein is replaced by that from AAV8. It is understood that any of the described vectors could be pseudotype derivatives, wherein the capsid protein used to package the AAV genome is derived from that of a different AAV serotype. Without wishing to be limited in vector choice, a list of exemplary AAV serotypes can be found in Table 18. In some embodiments, an AAV to be employed for gene modifying may be evolved for novel cell or tissue tropism as has been demonstrated in the literature (e.g., Davidsson et al. Proc Natl Acad Sci USA 2019).

In some embodiments, the AAV delivery vector is a vector which has two AAV inverted terminal repeats (ITRs) and a nucleotide sequence of interest (for example, a sequence coding for a gene modifying polypeptide or a DNA template, or both), each of said ITRs having an interrupted (or noncontiguous) palindromic sequence, i.e., a sequence composed of three segments: a first segment and a last segment that are identical when read 5'→3' but hybridize when placed against each other, and a segment that is different that separates the identical segments. See, for example, WO2012123430.

Conventionally, AAV virions with capsids are produced by introducing a plasmid or plasmids encoding the rAAV or scAAV genome, Rep proteins, and Cap proteins (Grimm et al, 1998). Upon introduction of these helper plasmids in trans, the AAV genome is "rescued" (i.e., released and subsequently recovered) from the host genome, and is further encapsidated to produce infectious AAV. In some embodiments, one or more gene modifying nucleic acids are packaged into AAV particles by introducing the ITR-flanked nucleic acids into a packaging cell in conjunction with the helper functions.

In some embodiments, the AAV genome is a so called self-complementary genome (referred to as scAAV), such that the sequence located between the ITRs contains both the desired nucleic acid sequence (e.g., DNA encoding the gene modifying polypeptide or template, or both) in addition to the reverse complement of the desired nucleic acid sequence, such that these two components can fold over and self-hybridize. In some embodiments, the self-complementary modules are separated by an intervening sequence that permits the DNA to fold back on itself, e.g., forms a stem-loop. An scAAV has the advantage of being poised for transcription upon entering the nucleus, rather than being first dependent on ITR priming and second-strand synthesis to form dsDNA. In some embodiments, one or more gene modifying components is designed as an scAAV, wherein the sequence between the AAV ITRs contains two reverse complementing modules that can self-hybridize to create dsDNA.

In some embodiments, nucleic acid (e.g., encoding a polypeptide, or a template, or both) delivered to cells is closed-ended, linear duplex DNA (CELiD DNA or ceDNA). In some embodiments, ceDNA is derived from the replicative form of the AAV genome (Li et al. PLoS One 2013). In some embodiments, the nucleic acid (e.g., encoding a polypeptide, or a template DNA, or both) is flanked by ITRs, e.g., AAV ITRs, wherein at least one of the ITRs comprises a terminal resolution site and a replication protein binding site (sometimes referred to as a replicative protein binding site). In some embodiments, the ITRs are derived from an adeno-associated virus, e.g., AAV1, AAV2, AAV3, AAV4, AAV5, AAV6, AAV7, AAV8, AAV9, AAV10, AAV11, AAV12, or a combination thereof. In some embodiments, the ITRs are symmetric. In some embodiments, the ITRs are asymmetric. In some embodiments, at least one Rep protein is provided to enable replication of the construct. In some embodiments, the at least one Rep protein is derived from an adeno-associated virus, e.g., AAV1, AAV2, AAV3, AAV4, AAV5, AAV6, AAV7, AAV8, AAV9, AAV10, AAV11, AAV12, or a combination thereof. In some embodiments, ceDNA is generated by providing a production cell with (i) DNA flanked by ITRs, e.g., AAV ITRs, and (ii) components required for ITR-dependent replication, e.g., AAV proteins Rep78 and Rep52 (or nucleic acid encoding the proteins). In some embodiments, ceDNA is free of any capsid protein, e.g., is not packaged into an infectious AAV particle. In some embodiments, ceDNA is formulated into LNPs (see, for example, WO2019051289A1).

In some embodiments, the ceDNA vector consists of two self-complementary sequences, e.g., asymmetrical or symmetrical or substantially symmetrical ITRs as defined herein, flanking said expression cassette, wherein the ceDNA vector is not associated with a capsid protein. In some embodiments, the ceDNA vector comprises two self-complementary sequences found in an AAV genome, where at least one ITR comprises an operative Rep-binding element (RBE) (also sometimes referred to herein as "RBS") and a terminal resolution site (trs) of AAV or a functional variant of the RBE. See, for example, WO2019113310.

In some embodiments, the AAV genome comprises two genes that encode four replication proteins and three capsid proteins, respectively. In some embodiments, the genes are flanked on either side by 145-bp inverted terminal repeats (ITRs). In some embodiments, the virion comprises up to three capsid proteins (Vp1, Vp2, and/or Vp3), e.g., produced in a 1:1:10 ratio. In some embodiments, the capsid proteins are produced from the same open reading frame and/or from differential splicing (Vp1) and alternative translational start sites (Vp2 and Vp3, respectively). Generally, Vp3 is the most abundant subunit in the virion and participates in receptor recognition at the cell surface defining the tropism of the virus. In some embodiments, Vp1 comprises a phospholipase domain, e.g., which functions in viral infectivity, in the N-terminus of Vp1.

In some embodiments, packaging capacity of the viral vectors limits the size of the gene modifying system that can be packaged into the vector. For example, the packaging capacity of the AAVs can be about 4.5 kb (e.g., about 3.0, 3.5, 4.0, 4.5, 5.0, 5.5, or 6.0 kb), e.g., including one or two inverted terminal repeats (ITRs), e.g., 145 base ITRs.

In some embodiments, recombinant AAV (rAAV) comprises cis-acting 145-bp ITRs flanking vector transgene cassettes, e.g., providing up to 4.5 kb for packaging of foreign DNA. Subsequent to infection, rAAV can, in some instances, express a fusion protein of the invention and persist without integration into the host genome by existing episomally in circular head-to-tail concatemers. rAAV can be used, for example, in vitro and in vivo. In some embodiments, AAV-mediated gene delivery requires that the length of the coding sequence of the gene is equal or greater in size than the wild-type AAV genome.

AAV delivery of genes that exceed this size and/or the use of large physiological regulatory elements can be accomplished, for example, by dividing the protein(s) to be delivered into two or more fragments. In some embodiments, the N-terminal fragment is fused to an intein-N sequence. In some embodiments, the C-terminal fragment is fused to an intein-C sequence. In embodiments, the fragments are packaged into two or more AAV vectors.

In some embodiments, dual AAV vectors are generated by splitting a large transgene expression cassette in two separate halves (5' and 3' ends, or head and tail), e.g., wherein each half of the cassette is packaged in a single AAV vector (of <5 kb). The re-assembly of the full-length transgene expression cassette can, in some embodiments, then be achieved upon co-infection of the same cell by both dual AAV vectors. In some embodiments, co-infection is followed by one or more of: (1) homologous recombination (HR) between 5' and 3' genomes (dual AAV overlapping vectors); (2) ITR-mediated tail-to-head concatemerization of 5' and 3' genomes (dual AAV trans-splicing vectors); and/or (3) a combination of these two mechanisms (dual AAV hybrid vectors). In some embodiments, the use of dual AAV vectors in vivo results in the expression of full-length proteins. In some embodiments, the use of the dual AAV vector platform represents an efficient and viable gene transfer strategy for transgenes of greater than about 4.0, 4.1, 4.2, 4.3, 4.4, 4.5, 4.6, 4.7, 4.8, 4.9, or 5.0 kb in size. In some embodiments, AAV vectors can also be used to transduce cells with target nucleic acids, e.g., in the in vitro production of nucleic acids and peptides. In some embodiments, AAV vectors can be used for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest.94:1351 (1994); each of which is incorporated herein by reference in their entirety). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol.63: 03822-3828 (1989) (incorporated by reference herein in their entirety).

In some embodiments, a gene modifying polypeptide described herein (e.g., with or without one or more guide nucleic acids) can be delivered using AAV, lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as described in U.S. Pat. No. 8,454,972 and as in clinical trials involving AAV. For adenovirus, the route of administration, formulation and dose can be as described in U.S. Pat. No. 8,404,658 and as in clinical trials involving adenovirus. For plasmid delivery, the route of administration, formulation and dose can be as described in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. In some embodiments, the viral vectors can be injected into the tissue of interest. For cell-type specific gene modifying, the expression of the gene modifying polypeptide and optional guide nucleic acid can, in some embodiments, be driven by a cell-type specific promoter.

In some embodiments, AAV allows for low toxicity, for example, due to the purification method not requiring ultracentrifugation of cell particles that can activate the immune response. In some embodiments, AAV allows low probability of causing insertional mutagenesis, for example, because it does not substantially integrate into the host genome.

In some embodiments, AAV has a packaging limit of about 4.4, 4.5, 4.6, 4.7, or 4.75 kb. In some embodiments, a gene modifying polypeptide-encoding sequence, promoter, and transcription terminator can fit into a single viral vector. SpCas9 (4.1 kb) may, in some instances, be difficult to package into AAV. Therefore, in some embodiments, a gene modifying polypeptide coding sequence is used that is shorter in length than other gene modifying polypeptide coding sequences or base editors. In some embodiments, the gene modifying polypeptide encoding sequences are less than about 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb.

An AAV can be AAV1, AAV2, AAV5 or any combination thereof. In some embodiments, the type of AAV is selected with respect to the cells to be targeted; e.g., AAV serotypes 1, 2, 5 or a hybrid capsid AAV1, AAV2, AAV5 or any combination thereof can be selected for targeting brain or neuronal cells; or AAV4 can be selected for targeting cardiac tissue. In some embodiments, AAV8 is selected for delivery to the liver. Exemplary AAV serotypes as to these cells are described, for example, in Grimm, D. et al, J. Virol.82: 5887-5911 (2008) (incorporated herein by reference in its entirety). In some embodiments, AAV refers all serotypes, subtypes, and naturally-occurring AAV as well as recombinant AAV. AAV may be used to refer to the virus itself or a derivative thereof. In some embodiments, AAV includes AAV1, AAV2, AAV3, AAV3B, AAV4, AAV5, AAV6, AAV6.2, AAV7, AAVrh.64R1, AAVhu.37, AAVrh.8, AAVrh.32.33, AAV8, AAV9, AAV-DJ, AAV2/8, AAVrh10, AAVLK03, AV10, AAV11, AAV 12, rh10, and hybrids thereof, avian AAV, bovine AAV, canine AAV, equine AAV, primate AAV, non-primate AAV, and ovine AAV. The genomic sequences of various serotypes of AAV, as well as the sequences of the native terminal repeats (TRs), Rep proteins, and capsid subunits are known in the art. Such sequences may be found in the literature or in public databases such as GenBank. Additional exemplary AAV serotypes are listed in Table 18.

TABLE 18

Exemplary AAV serotypes.

| Target Tissue | Vehicle | Reference |
|---|---|---|
| Liver | AAV (AAV8[1], AAVrh.8[1], AAVhu.37[1], AAV2/8, AAV2/rh10[2], AAV9, AAV2, NP40[3], NP59[2,3], AAV3B[5], AAV-DJ[4], AAV-LK01[4], AAV-LK02[4], AAV-LK03[4], AAV-LK19[4], AAV5[7]<br>Adenovirus (Ad5, HC-AdV[6]) | 1. Wang et al., *Mol. Ther.* 18, 118-25 (2010)<br>2. Ginn et al., *JHEP Reports*, 100065 (2019)<br>3. Paulk et al., *Mol. Ther.* 26, 289-303 (2018).<br>4. L. Lisowski et al., *Nature*. 506, 382-6 (2014).<br>5. L. Wang et al., *Mol. Ther.* 23, 1877-87 (2015).<br>6. Hausl *Mol Ther* (2010)<br>7. Davidoff et al., *Mol. Ther.* 11, 875-88 (2005) |
| Lung | AAV (AAV4, AAV5, AAV6[1], AAV9, H22[2])<br>Adenovirus (Ad5, Ad3, Ad21, Ad14)[3] | 1. Duncan et al., *Mol Ther Methods Clin Dev* (2018)<br>2. Cooney et al., Am J Respir Cell Mol Biol (2019)<br>3. Li et al., *Mol Ther Methods* Clin Dev (2019) |
| Skin | AAV (AAV6[1], AAV-LK19[2]) | 1. Petek et al., *Mol. Ther.* (2010)<br>2. L. Lisowski et al., *Nature*. 506, 382-6 (2014). |
| HSCs | Adenovirus (HDAd5/35[++]) | Wang et al. *Blood Adv* (2019) |

In some embodiments, a pharmaceutical composition (e.g., comprising an AAV as described herein) has less than 10% empty capsids, less than 8% empty capsids, less than 7% empty capsids, less than 5% empty capsids, less than 3% empty capsids, or less than 1% empty capsids. In some embodiments, the pharmaceutical composition has less than about 5% empty capsids. In some embodiments, the number of empty capsids is below the limit of detection. In some embodiments, it is advantageous for the pharmaceutical composition to have low amounts of empty capsids, e.g., because empty capsids may generate an adverse response (e.g., immune response, inflammatory response, liver response, and/or cardiac response), e.g., with little or no substantial therapeutic benefit.

In some embodiments, the residual host cell protein (rHCP) in the pharmaceutical composition is less than or equal to 100 ng/ml rHCP per $1\times10^{13}$ vg/ml, e.g., less than or equal to 40 ng/ml rHCP per $1\times10^{13}$ vg/ml or 1-50 ng/ml rHCP per $1\times10^{13}$ vg/ml. In some embodiments, the pharmaceutical composition comprises less than 10 ng rHCP per $1.0\times10^{13}$ vg, or less than 5 ng rHCP per $1.0\times10^{13}$ vg, less than 4 ng rHCP per $1.0\times10^{13}$ vg, or less than 3 ng rHCP per $1.0\times10^{13}$ vg, or any concentration in between. In some embodiments, the residual host cell DNA (hcDNA) in the pharmaceutical composition is less than or equal to $5\times10^{6}$ pg/ml hcDNA per $1\times10^{13}$ vg/ml, less than or equal to $1.2\times10^{6}$ pg/ml hcDNA per $1\times10^{13}$ vg/ml, or $1\times10^{5}$ pg/ml hcDNA per $1\times10^{13}$ vg/ml. In some embodiments, the residual host cell DNA in said pharmaceutical composition is less than $5.0\times10^{5}$ pg per $1\times10^{13}$ vg, less than $2.0\times10^{5}$ pg per $1.0\times10^{13}$ vg, less than $1.1\times10^{5}$ pg per $1.0\times10^{13}$ vg, less than $1.0\times10^{5}$ pg hcDNA per $1.0\times10^{13}$ vg, less than $0.9\times10^{5}$ pg hcDNA per $1.0\times10^{13}$ vg, less than $0.8\times10^{5}$ pg hcDNA per $1.0\times10^{13}$ vg, or any concentration in between.

In some embodiments, the residual plasmid DNA in the pharmaceutical composition is less than or equal to $1.7\times10^{5}$ pg/ml per $1.0\times10^{13}$ vg/ml, or $1\times10^{5}$ pg/ml per $1\times1.0\times10^{13}$ vg/ml, or $1.7\times10^{6}$ pg/ml per $1.0\times10^{13}$ vg/ml. In some embodiments, the residual DNA plasmid in the pharmaceutical composition is less than $10.0\times10^{5}$ pg by $1.0\times10^{13}$ vg, less than $8.0\times10^{5}$ pg by $1.0\times10^{13}$ vg or less than $6.8\times10^{5}$ pg by $1.0\times10^{13}$ vg. In embodiments, the pharmaceutical composition comprises less than 0.5 ng per $1.0\times10^{13}$ vg, less than 0.3 ng per $1.0\times10^{13}$ vg, less than 0.22 ng per $1.0\times10^{13}$ vg or less than 0.2 ng per $1.0\times10^{13}$ vg or any intermediate concentration of bovine serum albumin (BSA). In embodiments, the benzonase in the pharmaceutical composition is less than 0.2 ng by $1.0\times10^{13}$ vg, less than 0.1 ng by $1.0\times10^{13}$ vg, less than 0.09 ng by $1.0\times10^{13}$ vg, less than 0.08 ng by $1.0\times10^{13}$ vg or any intermediate concentration. In embodiments, Poloxamer 188 in the pharmaceutical composition is about 10 to 150 ppm, about 15 to 100 ppm or about 20 to 80 ppm. In embodiments, the cesium in the pharmaceutical composition is less than 50 pg/g (ppm), less than 30 pg/g (ppm) or less than 20 pg/g (ppm) or any intermediate concentration.

In embodiments, the pharmaceutical composition comprises total impurities, e.g., as determined by SDS-PAGE, of less than 10%, less than 8%, less than 7%, less than 6%, less than 5%, less than 4%, less than 3%, less than 2%, or any percentage in between. In embodiments, the total purity, e.g., as determined by SDS-PAGE, is greater than 90%, greater than 92%, greater than 93%, greater than 94%, greater than 95%, greater than 96%, greater than 97%, greater than 98%, or any percentage in between. In embodiments, no single unnamed related impurity, e.g., as measured by SDS-PAGE, is greater than 5%, greater than 4%, greater than 3% or greater than 2%, or any percentage in between. In embodiments, the pharmaceutical composition comprises a percentage of filled capsids relative to total capsids (e.g., peak 1+peak 2 as measured by analytical ultracentrifugation) of greater than 85%, greater than 86%, greater than 87%, greater than 88%, greater than 89%, greater than 90%, greater than 91%, greater than 91.9%, greater than 92%, greater than 93%, or any percentage in between. In embodiments of the pharmaceutical composition, the percentage of filled capsids measured in peak 1 by analytical ultracentrifugation is 20-80%, 25-75%, 30-75%, 35-75%, or 37.4-70.3%. In embodiments of the pharmaceutical composition, the percentage of filled capsids measured in peak 2 by analytical ultracentrifugation is 20-80%, 20-70%, 22-65%, 24-62%, or 24.9-60.1%.

In one embodiment, the pharmaceutical composition comprises a genomic titer of 1.0 to $5.0\times10^{13}$ vg/mL, 1.2 to $3.0\times10^{13}$ vg/mL or 1.7 to $2.3\times10^{13}$ vg/ml. In one embodiment, the pharmaceutical composition exhibits a biological load of less than 5 CFU/mL, less than 4 CFU/mL, less than 3 CFU/mL, less than 2 CFU/mL or less than 1 CFU/mL or any intermediate contraction. In embodiments, the amount of endotoxin according to USP, for example, USP <85> (incorporated by reference in its entirety) is less than 1.0 EU/mL, less than 0.8 EU/mL or less than 0.75 EU/mL. In embodiments, the osmolarity of a pharmaceutical composition according to USP, for example, USP <785> (incorporated by reference in its entirety) is 350 to 450 mOsm/kg, 370 to 440 mOsm/kg or 390 to 430 mOsm/kg. In embodiments, the pharmaceutical composition contains less than 1200 particles that are greater than 25 μm per container, less than 1000 particles that are greater than 25 μm per container, less than 500 particles that are greater than 25 μm per container or any intermediate value. In embodiments, the pharmaceutical composition contains less than 10,000 particles that are greater than 10 μm per container, less than 8000 particles that are greater than 10 μm per container or less than 600 particles that are greater than 10 pm per container.

In one embodiment, the pharmaceutical composition has a genomic titer of 0.5 to $5.0\times10^{13}$ vg/mL, 1.0 to $4.0\times10^{13}$ vg/mL, 1.5 to $3.0\times10^{13}$ vg/ml or 1.7 to $2.3\times10^{13}$ vg/ml. In one embodiment, the pharmaceutical composition described herein comprises one or more of the following: less than about 0.09 ng benzonase per $1.0\times10^{13}$ vg, less than about 30 pg/g (ppm) of cesium, about 20 to 80 ppm Poloxamer 188, less than about 0.22 ng BSA per $1.0\times10^{13}$ vg, less than about $6.8\times10^{5}$ pg of residual DNA plasmid per $1.0\times10^{13}$ vg, less than about $1.1\times10^{5}$ pg of residual hcDNA per $1.0\times10^{13}$ vg, less than about 4 ng of rHCP per $1.0\times10^{13}$ vg, pH 7.7 to 8.3, about 390 to 430 mOsm/kg, less than about 600 particles that are >25 μm in size per container, less than about 6000 particles that are >10 μm in size per container, about $1.7\times10^{13}$-$2.3\times10^{13}$ vg/mL genomic titer, infectious titer of about $3.9\times10^{8}$ to $8.4\times10^{10}$ IU per $1.0\times10^{13}$ vg, total protein of about 100-300 μg per $1.0\times10^{13}$ vg, mean survival of >24 days in A7SMA mice with about $7.5\times10^{13}$ vg/kg dose of viral vector, about 70 to 130% relative potency based on an in vitro cell based assay and/or less than about 5% empty capsid. In various embodiments, the pharmaceutical compositions described herein comprise any of the viral particles discussed here, retain a potency of between ±20%, between ±15%, between ±10% or within ±5% of a reference standard. In some embodiments, potency is measured using a suitable in vitro cell assay or in vivo animal model.

Additional methods of preparation, characterization, and dosing AAV particles are taught in WO2019094253, which is incorporated herein by reference in its entirety.

Additional rAAV constructs that can be employed consonant with the invention include those described in Wang et al 2019, available at: //doi.org/10.1038/s41573-019-0012-9, including Table 1 thereof, which is incorporated by reference in its entirety.

Lipid Nanoparticles

The methods and systems provided herein may employ any suitable carrier or delivery modality, including, in certain embodiments, lipid nanoparticles (LNPs). Lipid nanoparticles, in some embodiments, comprise one or more ionic lipids, such as non-cationic lipids (e.g., neutral or anionic, or zwitterionic lipids); one or more conjugated lipids (such as PEG-conjugated lipids or lipids conjugated to polymers described in Table 5 of WO2019217941; incorporated herein by reference in its entirety); one or more sterols (e.g., cholesterol); and, optionally, one or more targeting molecules (e.g., conjugated receptors, receptor ligands, antibodies); or combinations of the foregoing.

Lipids that can be used in nanoparticle formations (e.g., lipid nanoparticles) include, for example those described in Table 4 of WO2019217941, which is incorporated by reference—e.g., a lipid-containing nanoparticle can comprise one or more of the lipids in Table 4 of WO2019217941. Lipid nanoparticles can include additional elements, such as polymers, such as the polymers described in Table 5 of WO2019217941, incorporated by reference.

In some embodiments, conjugated lipids, when present, can include one or more of PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), PEG succinate diacylglycerol (PEGS-DAG) (such as 4-0-(2',3'-di(tetradecanoyloxy)propyl-1-0-(w-methoxy(polyethoxy)ethyl) butanedioate (PEG-S-DMG)), PEG dialkoxypropylcarbam, N-(carbonyl-methoxypoly ethylene glycol 2000)-1,2-distearoyl-sn-glycero-3-phosphoethanolamine sodium salt, and those described in Table 2 of WO2019051289 (incorporated by reference), and combinations of the foregoing.

In some embodiments, sterols that can be incorporated into lipid nanoparticles include one or more of cholesterol or cholesterol derivatives, such as those in WO2009/127060 or US2010/0130588, which are incorporated by reference. Additional exemplary sterols include phytosterols, including those described in Eygeris et al (2020), dx.doi.org/10.1021/acs.nanolett.0c01386, incorporated herein by reference.

In some embodiments, the lipid particle comprises an ionizable lipid, a non-cationic lipid, a conjugated lipid that inhibits aggregation of particles, and a sterol. The amounts of these components can be varied independently and to achieve desired properties. For example, in some embodiments, the lipid nanoparticle comprises an ionizable lipid is in an amount from about 20 mol % to about 90 mol % of the total lipids (in other embodiments it may be 20-70% (mol), 30-60% (mol) or 40-50% (mol); about 50 mol % to about 90 mol % of the total lipid present in the lipid nanoparticle), a non-cationic lipid in an amount from about 5 mol % to about 30 mol % of the total lipids, a conjugated lipid in an amount from about 0.5 mol % to about 20 mol % of the total lipids, and a sterol in an amount from about 20 mol % to about 50 mol % of the total lipids. The ratio of total lipid to nucleic acid (e.g., encoding the gene modifying polypeptide or template nucleic acid) can be varied as desired. For example, the total lipid to nucleic acid (mass or weight) ratio can be from about 10:1 to about 30:1.

In some embodiments, an ionizable lipid may be a cationic lipid, an ionizable cationic lipid, e.g., a cationic lipid that can exist in a positively charged or neutral form depending on pH, or an amine-containing lipid that can be readily protonated. In some embodiments, the cationic lipid is a lipid capable of being positively charged, e.g., under physiological conditions. Exemplary cationic lipids include one or more amine group(s) which bear the positive charge. In some embodiments, the lipid particle comprises a cationic lipid in formulation with one or more of neutral lipids, ionizable amine-containing lipids, biodegradable alkyn lipids, steroids, phospholipids including polyunsaturated lipids, structural lipids (e.g., sterols), PEG, cholesterol and polymer conjugated lipids. In some embodiments, the cationic lipid may be an ionizable cationic lipid. An exemplary cationic lipid as disclosed herein may have an effective pKa over 6.0. In embodiments, a lipid nanoparticle may comprise a second cationic lipid having a different effective pKa (e.g., greater than the first effective pKa), than the first cationic lipid. A lipid nanoparticle may comprise between 40 and 60 mol percent of a cationic lipid, a neutral lipid, a steroid, a polymer conjugated lipid, and a therapeutic agent, e.g., a nucleic acid (e.g., RNA) described herein (e.g., a template nucleic acid or a nucleic acid encoding a gene modifying polypeptide), encapsulated within or associated with the lipid nanoparticle. In some embodiments, the nucleic acid is co-formulated with the cationic lipid. The nucleic acid may be adsorbed to the surface of an LNP, e.g., an LNP comprising a cationic lipid. In some embodiments, the nucleic acid may be encapsulated in an LNP, e.g., an LNP comprising a cationic lipid. In some embodiments, the lipid nanoparticle may comprise a targeting moiety, e.g., coated with a targeting agent. In embodiments, the LNP formulation is biodegradable. In some embodiments, a lipid nanoparticle comprising one or more lipid described herein, e.g., Formula (i), (ii), (ii), (vii) and/or (ix) encapsulates at least 1%, at least 5%, at least 10%, at least 20%, at least 30%, at least 40%, at least 50%, at least 60%, at least 70%, at least 80%, at least 90%, at least 92%, at least 95%, at least 97%, at least 98% or 100% of an RNA molecule, e.g., template RNA and/or a mRNA encoding the gene modifying polypeptide.

In some embodiments, the lipid to nucleic acid ratio (mass/mass ratio; w/w ratio) can be in the range of from about 1:1 to about 25:1, from about 10:1 to about 14:1, from about 3:1 to about 15:1, from about 4:1 to about 10:1, from about 5:1 to about 9:1, or about 6:1 to about 9:1. The amounts of lipids and nucleic acid can be adjusted to provide a desired N/P ratio, for example, N/P ratio of 3, 4, 5, 6, 7, 8, 9, 10 or higher. Generally, the lipid nanoparticle formulation's overall lipid content can range from about 5 mg/ml to about 30 mg/mL.

Exemplary ionizable lipids that can be used in lipid nanoparticle formulations include, without limitation, those listed in Table 1 of WO2019051289, incorporated herein by reference. Additional exemplary lipids include, without limitation, one or more of the following formulae: X of US2016/0311759; I of US20150376115 or in US2016/0376224; I, II or III of US20160151284; I, IA, II, or IIA of US20170210967; I-c of US20150140070; A of US2013/0178541; I of US2013/0303587 or US2013/0123338; I of US2015/0141678; II, III, IV, or V of US2015/0239926; I of US2017/0119904; I or II of WO2017/117528; A of US2012/0149894; A of US2015/0057373; A of WO2013/116126; A of US2013/0090372; A of US2013/0274523; A of US2013/0274504; A of US2013/0053572; A of WO2013/016058; A of WO2012/162210; I of US2008/042973; I, II, III, or IV of US2012/01287670; I or II of US2014/0200257; I, II, or III of US2015/0203446; I or III of US2015/0005363; I, IA, IB, IC, ID, II, IIA, IIB, IIC, IID, or III-XXIV of US2014/0308304; of US2013/0338210; I, II, III, or IV of WO2009/132131; A of US2012/01011478; I or XXXV of US2012/0027796; XIV or XVII of US2012/0058144; of US2013/0323269; I of US2011/0117125; I, II, or III of US2011/0256175; I, II, III, IV, V, VI, VII, VIII, IX, X, XI, XII of US2012/0202871; I, II, III, IV, V, VI, VII, VIII, X, XII, XIII, XIV, XV, or XVI of US2011/0076335; I or II of US2006/008378; I of US2013/0123338; I or X-A-Y-Z of US2015/0064242; XVI, XVII, or XVIII of US2013/0022649; I, II, or III of US2013/0116307; I, II, or III of US2013/0116307; I or II of US2010/0062967; I-X of US2013/0189351; I of US2014/0039032; V of US2018/0028664; I of US2016/0317458; I of US2013/0195920; 5, 6, or 10 of U.S. Pat. No. 10,221,127; 111-3 of WO2018/081480; I-5 or I-8 of WO2020/081938; 18 or 25 of U.S. Pat. No. 9,867,888; A of US2019/0136231; II of WO2020/219876; 1 of US2012/0027803; OF-02 of US2019/0240349; 23 of U.S. Pat. No. 10,086,013; cKK-E12/A6 of Miao et al (2020); C12-200 of WO2010/053572; 7C1 of Dahlman et al (2017); 304-O13 or 503-O13 of Whitehead et al; TS-P4C2 of U.S. Pat. No. 9,708,628; I of WO2020/106946; I of WO2020/106946.

In some embodiments, the ionizable lipid is MC3 (6Z, 9Z,28Z,3 1Z)-heptatriaconta-6,9,28,31-tetraen-19-yl-4-(dimethylamino) butanoate (DLin-MC3-DMA or MC3), e.g., as described in Example 9 of WO2019051289A9 (incorporated by reference herein in its entirety). In some embodiments, the ionizable lipid is the lipid ATX-002, e.g., as described in Example 10 of WO2019051289A9 (incorporated by reference herein in its entirety). In some embodiments, the ionizable lipid is (13Z,16Z)-A,A-dimethyl-3-nonyldocosa-13,16-dien-1-amine (Compound 32), e.g., as described in Example 11 of WO2019051289A9 (incorporated by reference herein in its entirety). In some embodiments, the ionizable lipid is Compound 6 or Compound 22, e.g., as described in Example 12 of WO2019051289A9 (incorporated by reference herein in its entirety). In some embodiments, the ionizable lipid is heptadecan-9-yl 8-((2-hydroxyethyl)(6-oxo-6-(undecyloxy)hexyl)amino)octanoate (SM-102); e.g., as described in Example 1 of U.S. Pat. No. 9,867,888 (incorporated by reference herein in its entirety). In some embodiments, the ionizable lipid is 9Z,12Z)-3-((4,4-bis(octyloxy)butanoyl)oxy)-2-((((3-(diethylamino)propoxy)carbonyl)oxy)methyl)propyl octadeca-9, 12-dienoate (LP01) e.g., as synthesized in Example 13 of WO2015/095340 (incorporated by reference herein in its entirety). In some embodiments, the ionizable lipid is Di((Z)-non-2-en-1-yl) 9-((4-dimethylamino)butanoyl)oxy) heptadecanedioate (L319), e.g. as synthesized in Example 7, 8, or 9 of US2012/0027803 (incorporated by reference herein in its entirety). In some embodiments, the ionizable lipid is 1,1'-((2-(4-(2-((2-(Bis(2-hydroxydodecyl)amino) ethyl)(2-hydroxydodecyl)amino)ethyl)piperazin-1-yl)ethyl) azanediyl)bis(dodecan-2-01) (C12-200), e.g., as synthesized in Examples 14 and 16 of WO2010/053572 (incorporated by reference herein in its entirety). In some embodiments, the ionizable lipid is; Imidazole cholesterol ester (ICE) lipid (3S, 10R, 13R, 17R)-10, 13-dimethyl-17-((R)-6-methylheptan-2-yl)-2, 3, 4, 7, 8, 9, 10, 11, 12, 13, 14, 15, 16, 17-tetradecahydro-1H-cyclopenta[a]phenanthren-3-yl3-(1H-imidazol-4-yl)propanoate, e.g., Structure (I) from WO2020/106946 (incorporated by reference herein in its entirety).

Some non-limiting examples of lipid compounds that may be used (e.g., in combination with other lipid components) to form lipid nanoparticles for the delivery of compositions described herein, e.g., nucleic acid (e.g., RNA) described herein (e.g., a template nucleic acid or a nucleic acid encoding a gene modifying polypeptide) includes, (i)

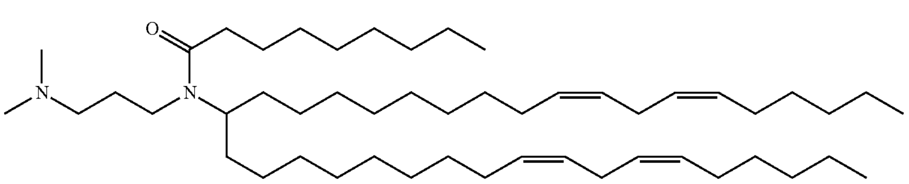

In some embodiments an LNP comprising Formula (i) is used to deliver a gene modifying composition described herein to the liver and/or hepatocyte cells.

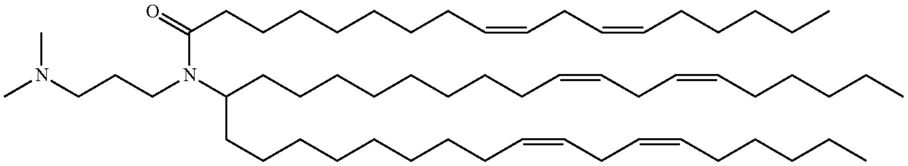

(ii)

In some embodiments an LNP comprising Formula (ii) is used to deliver a gene modifying composition described herein to the liver and/or hepatocyte cells.

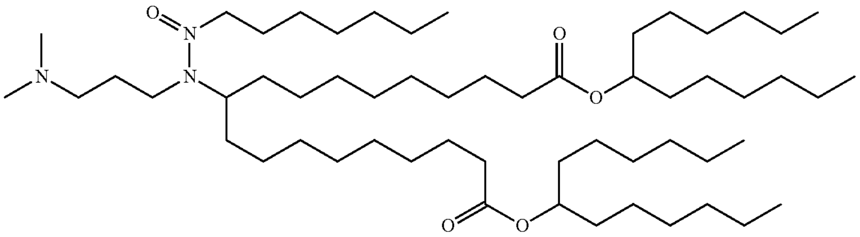

(iii)

In some embodiments an LNP comprising Formula (iii) is used to deliver a gene modifying composition described herein to the liver and/or hepatocyte cells.

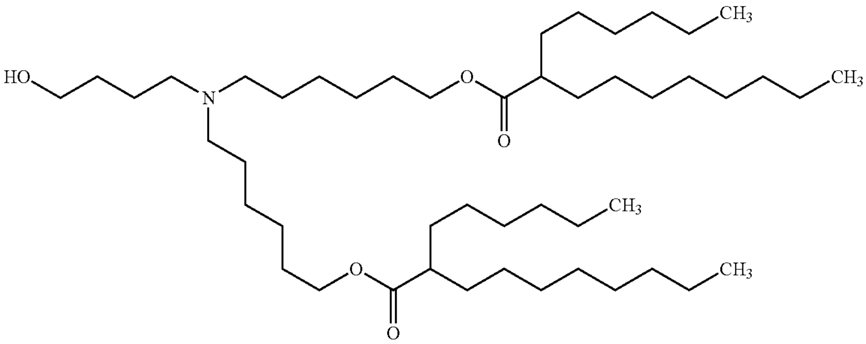

(iv)

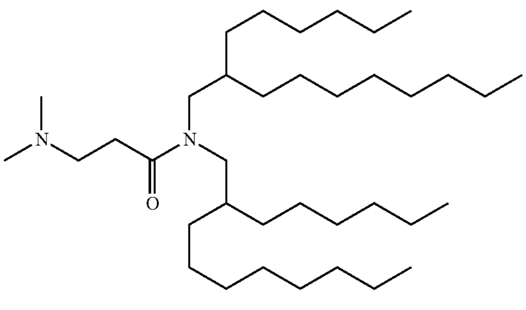

(v)

In some embodiments an LNP comprising Formula (v) is used to deliver a gene modifying composition described herein to the liver and/or hepatocyte cells.

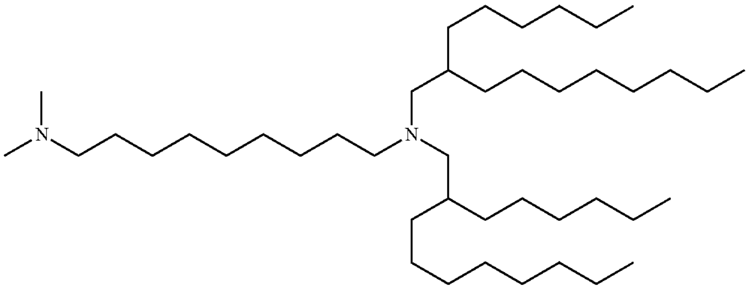

(vi)

In some embodiments an LNP comprising Formula (vi) is used to deliver a gene modifying composition described herein to the liver and/or hepatocyte cells.

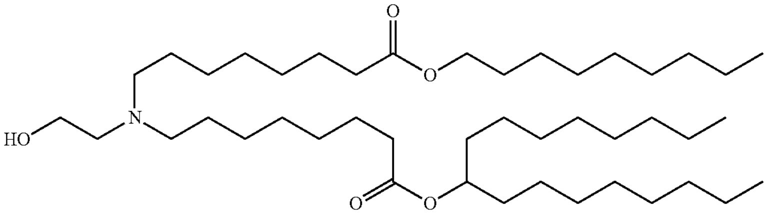

(vii)

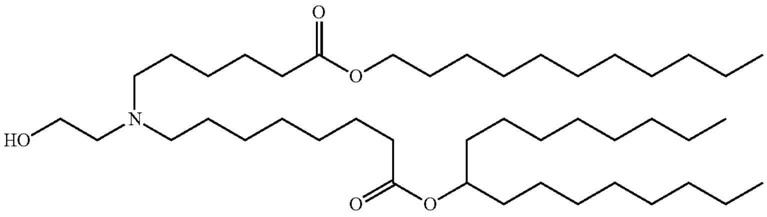

(viii)

In some embodiments an LNP comprising Formula (viii) is used to deliver a gene modifying composition described herein to the liver and/or hepatocyte cells.

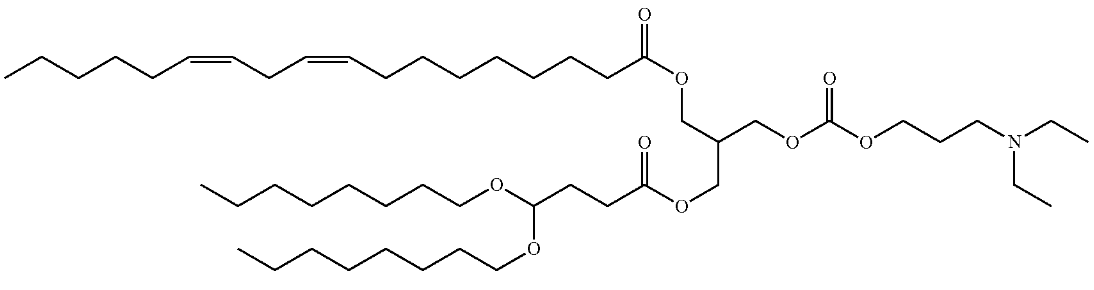

(ix)

In some embodiments an LNP comprising Formula (ix) is used to deliver a gene modifying composition described herein to the liver and/or hepatocyte cells.

(x)

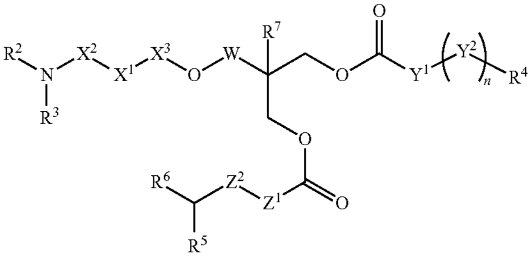

wherein $X^1$ is O, $NR^1$, or a direct bond, $X^2$ is C2-5 alkylene, $X^3$ is C(=0) or a direct bond, $R^1$ is H or Me, $R^3$ is Ci-3 alkyl, $R^2$ is Ci-3 alkyl, or $R^2$ taken together with the nitrogen atom to which it is attached and 1-3 carbon atoms of $X^2$ form a 4-, 5-, or 6-membered ring, or $X^1$ is $NR^1$, $R^1$ and $R^2$ taken together with the nitrogen atoms to which they are attached form a 5- or 6-membered ring, or $R^2$ taken together with $R^3$ and the nitrogen atom to which they are attached form a 5-, 6-, or 7-membered ring, $Y^1$ is C2-12 alkylene. $Y^2$ is selected from

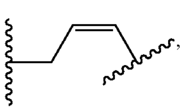

(in either orientation)

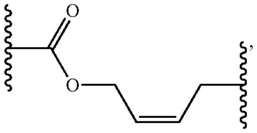

(in either orientation)

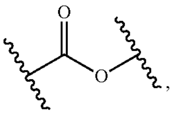

(in either orientation)

n is 0 to 3, $R^4$ is Ci-15 alkyl, $Z^1$ is Ci-6 alkylene or a direct bond, $Z^2$ is

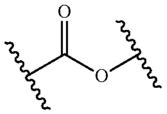 [SMILES: *OC(*)=O]

(in either orientation) or absent, provided that if $Z^1$ is a direct bond, $Z^2$ is absent;

$R^5$ is C5-9 alkyl or C6-10 alkoxy, $R^6$ is C5-9 alkyl or C6-10 alkoxy, W is methylene or a direct bond, and $R^7$ is H or Me, or a salt thereof, provided that if $R^3$ and $R^2$ are C2 alkyls, $X^1$ is O, $X^2$ is linear C3 alkylene, $X^3$ is C(=0), $Y^1$ is linear Ce alkylene, $(Y^2)n-R^4$ is

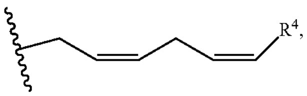

$R^4$ is linear C5 alkyl, $Z^1$ is C2 alkylene, $Z^2$ is absent, W is methylene, and $R^7$ is H, then $R^5$ and $R^6$ are not Cx alkoxy.

In some embodiments an LNP comprising Formula (xii) is used to deliver a gene modifying composition described herein to the liver and/or hepatocyte cells.

(xi)

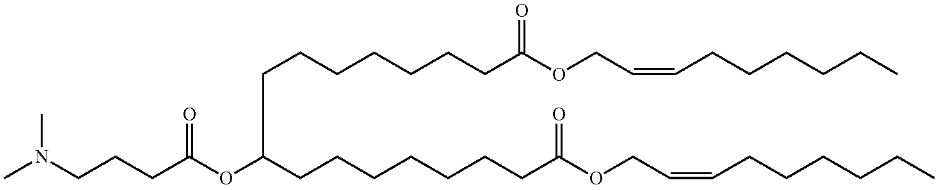

In some embodiments an LNP comprising Formula (xi) is used to deliver a gene modifying composition described herein to the liver and/or hepatocyte cells.

(xii)

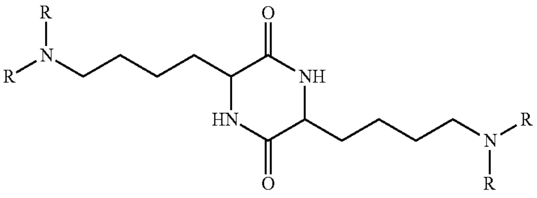

-continued

R =

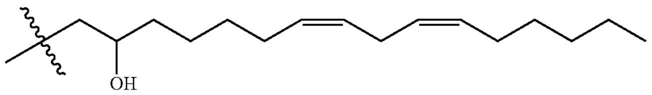

OF-02 where R =

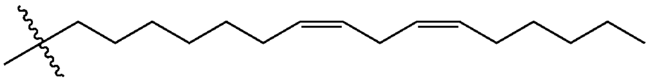

(xiii)

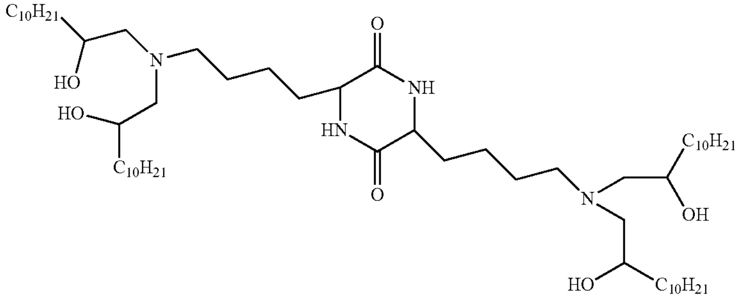

(xiv)

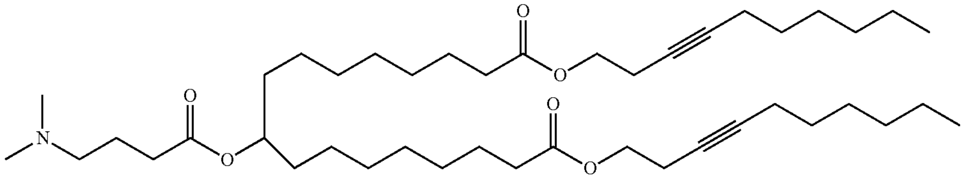

In some embodiments an LNP comprises a compound of Formula (xiii) and a compound of Formula (xiv).

(xv)

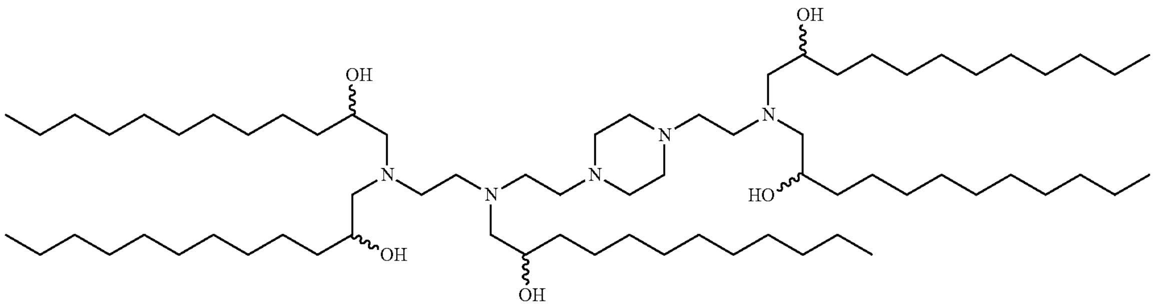

In some embodiments an LNP comprising Formula (xv) is used to deliver a gene modifying composition described herein to the liver and/or hepatocyte cells.

(xvi)

$PEI_{600}Core$

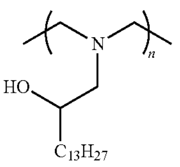

In some embodiments an LNP comprising a formulation of Formula (xvi) is used to deliver a gene modifying composition described herein to the lung endothelial cells.

(xvii)
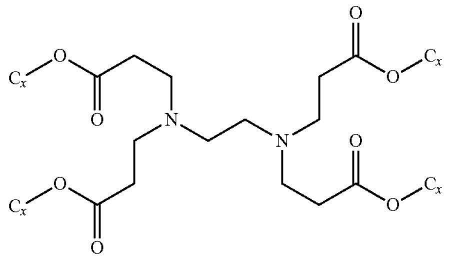
(xviii) (a)
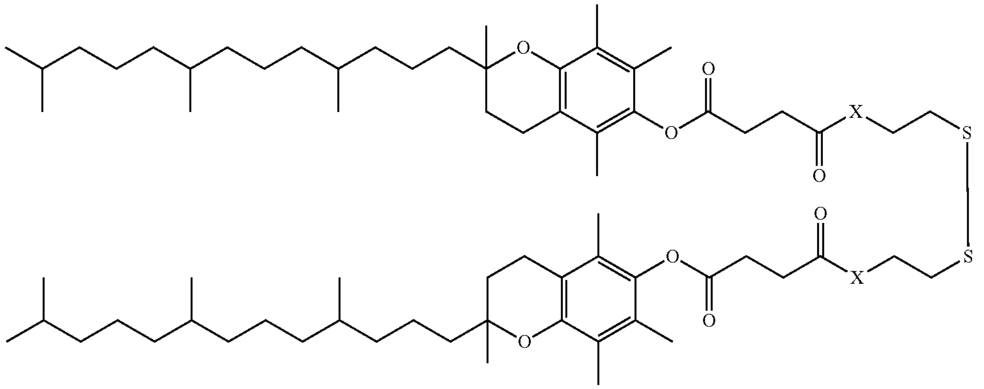
X = amino structure
where X = 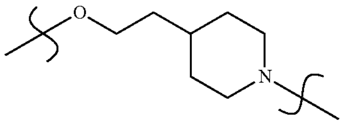
(xviii)(b)
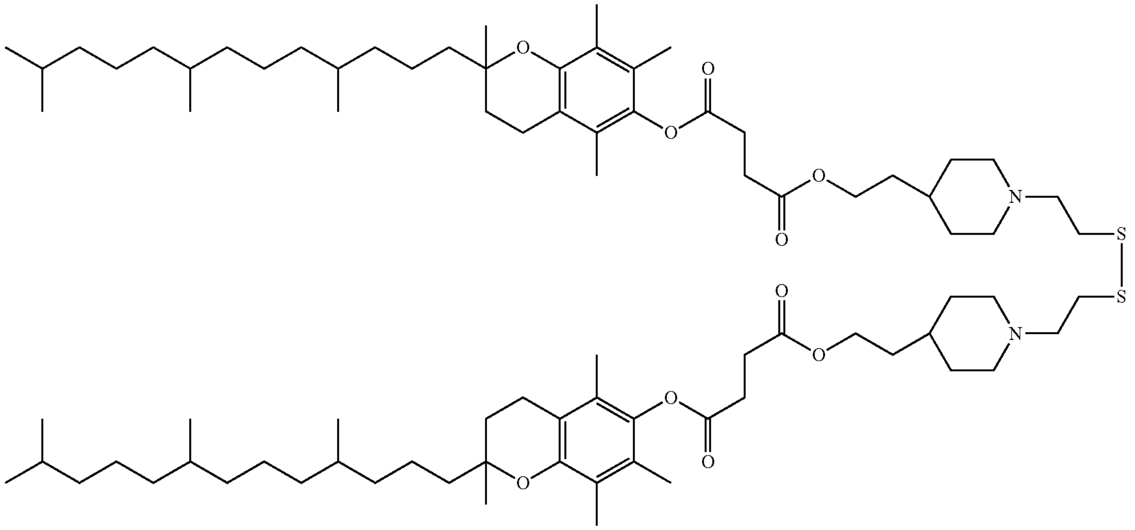

-continued (xix)

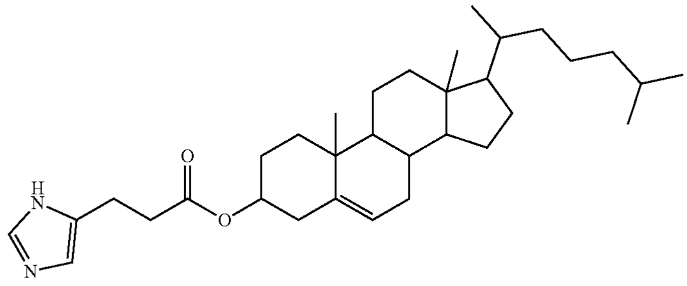

In some embodiments, a lipid compound used to form lipid nanoparticles for the delivery of compositions described herein, e.g., nucleic acid (e.g., RNA) described herein (e.g., a template nucleic acid or a nucleic acid encoding a gene modifying polypeptide) is made by one of the following reactions:

(xx)(a)

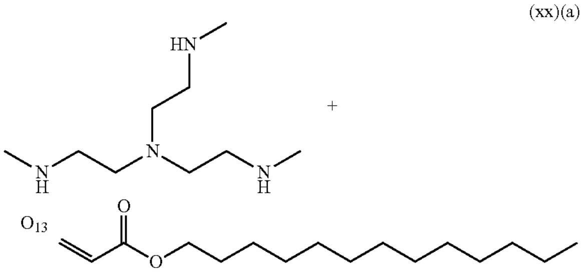

(xx)(b)

503

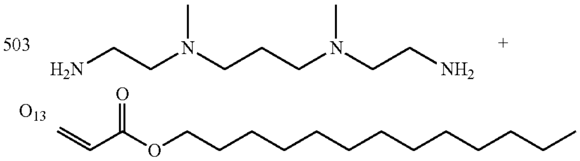

Exemplary non-cationic lipids include, but are not limited to, distearoyl-sn-glycero-phosphoethanolamine, di dyl-ethanolamine (DSPE), monomethyl-phosphatidylethanolamine (such as 16-O-monomethyl PE), dimethyl-phosphatidylethanolamine (such as 16-O-dimethyl PE), 18-1-trans PE, 1-stearoyl-2-oleoyl-phosphatidyethanolamine (SOPE), hydrogenated soy phosphatidylcholine (HSPC), egg phosphatidylcholine (EPC), dioleoylphosphatidylserine (DOPS), sphingomyelin (SM), dimyristoyl phosphatidylcholine (DMPC), dimyristoyl phosphatidylglycerol (DMPG), di stearoylphosphatidylglycerol (DSPG), dierucoylphosphatidylcholine (DEPC), palmitoyloleyolphosphatidylglycerol (POPG), dielaidoyl-phosphatidylethanolamine (DEPE), lecithin, phosphatidylethanolamine, lysolecithin, lysophosphatidylethanolamine, phosphatidylserine, phosphatidylinositol, sphingomyelin, egg sphingomyelin (ESM), cephalin, cardiolipin, phosphatidicacid, cerebrosides, dicetylphosphate, lysophosphatidylcholine, dilinoleoylphosphatidylcholine, or mixtures thereof. It is understood that other diacylphosphatidylcholine and diacylphosphatidylethanolamine phospholipids can also be used. The acyl groups in these lipids are preferably acyl groups derived from fatty acids having C10-C24 carbon chains, e.g., lauroyl, myristoyl, paimitoyl, stearoyl, or oleoyl. Additional exemplary lipids, in certain embodiments, include, without limitation, those described in Kim et al. (2020) dx.doi.org/10.1021/acs.nanolett.0c01386, incorporated herein by reference. Such lipids include, in some embodiments, plant lipids found to improve liver transfection with mRNA (e.g., DGTS). In some embodiments, the non-cationic lipid may have the following structure, (xxi)

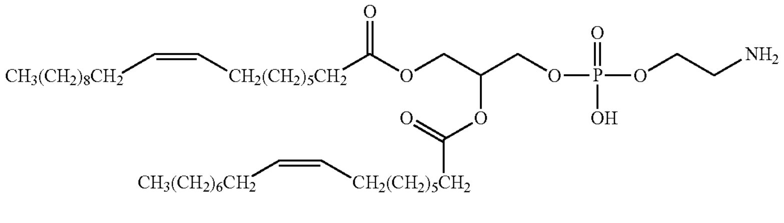

stearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), 1,2-dioleoyl-sn-glycero-3-phosphoethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphati- Other examples of non-cationic lipids suitable for use in the lipid nanopartieles include, without limitation, nonphosphorous lipids such as, e.g., stearylamine, dodeeylamine, hexadecylamine, acetyl palmitate, glycerol ricinoleate, hexadecyl stereate, isopropyl myristate, amphoteric acrylic polymers, triethanolamine-lauryl sulfate, alkyl-aryl sulfate polyethyloxylated fatty acid amides, dioctadecyl dimethyl ammonium bromide, ceramide, sphingomyelin, and the like. Other non-cationic lipids are described in WO2017/099823 or US patent publication US2018/0028664, the contents of which is incorporated herein by reference in their entirety.

In some embodiments, the non-cationic lipid is oleic acid or a compound of Formula I, II, or IV of US2018/0028664, incorporated herein by reference in its entirety. The non-cationic lipid can comprise, for example, 0-30% (mol) of the total lipid present in the lipid nanoparticle. In some embodiments, the non-cationic lipid content is 5-20% (mol) or 10-15% (mol) of the total lipid present in the lipid nanoparticle. In embodiments, the molar ratio of ionizable lipid to the neutral lipid ranges from about 2:1 to about 8:1 (e.g., about 2:1, 3:1, 4:1, 5:1, 6:1, 7:1, or 8:1).

In some embodiments, the lipid nanoparticles do not comprise any phospholipids.

In some aspects, the lipid nanoparticle can further comprise a component, such as a sterol, to provide membrane integrity. One exemplary sterol that can be used in the lipid nanoparticle is cholesterol and derivatives thereof. Non-limiting examples of cholesterol derivatives include polar analogues such as 5a-choiestanol, 53-coprostanol, choiesteryl-(2-hydroxy)-ethyl ether, choiesteryl-(4'-hydroxy)-butyl ether, and 6-ketocholestanol; non-polar analogues such as 5a-cholestane, cholestenone, 5a-cholestanone, 5p-cholestanone, and cholesteryl decanoate; and mixtures thereof. In some embodiments, the cholesterol derivative is a polar analogue, e.g., choiesteryl-(4'-hydroxy)-butyl ether. Exemplary cholesterol derivatives are described in PCT publication WO2009/127060 and US patent publication US2010/0130588, each of which is incorporated herein by reference in its entirety.

In some embodiments, the component providing membrane integrity, such as a sterol, can comprise 0-50% (mol) (e.g., 0-10%, 10-20%, 20-30%, 30-40%, or 40-50%) of the total lipid present in the lipid nanoparticle. In some embodiments, such a component is 20-50% (mol) 30-40% (mol) of the total lipid content of the lipid nanoparticle.

In some embodiments, the lipid nanoparticle can comprise a polyethylene glycol (PEG) or a conjugated lipid molecule. Generally, these are used to inhibit aggregation of lipid nanoparticles and/or provide steric stabilization. Exemplary conjugated lipids include, but are not limited to, PEG-lipid conjugates, polyoxazoline (POZ)-lipid conjugates, polyamide-lipid conjugates (such as ATTA-lipid conjugates), cationic-polymer lipid (CPL) conjugates, and mixtures thereof. In some embodiments, the conjugated lipid molecule is a PEG-lipid conjugate, for example, a (methoxy polyethylene glycol)-conjugated lipid.

Exemplary PEG-lipid conjugates include, but are not limited to, PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), 1,2-dimyristoyl-sn-glycerol, methoxypoly ethylene glycol (DMG-PEG-2K), PEG succinate diacylglycerol (PEGS-DAG) (such as 4-0-(2',3'-di(tetradecanoyloxy)propyl-1-0-(w-methoxy(polyethoxy)ethyl) butanedioate (PEG-S-DMG)), PEG dialkoxypropylcarbam, N-(carbonyl-methoxypolyethylene glycol 2000)-1,2-distearoyl-sn-glycero-3-phosphoethanolamine sodium salt, or a mixture thereof. Additional exemplary PEG-lipid conjugates are described, for example, in U.S. Pat. Nos. 5,885,613, 6,287,591, US2003/0077829, US2003/0077829, US2005/0175682, US2008/0020058, US2011/0117125, US2010/0130588, US2016/0376224, US2017/0119904, and US/099823, the contents of all of which are incorporated herein by reference in their entirety. In some embodiments, a PEG-lipid is a compound of Formula III, III-a-I, III-b-1, III-b-2, or V of US2018/0028664, the content of which is incorporated herein by reference in its entirety. In some embodiments, a PEG-lipid is of Formula II of US20150376115 or US2016/0376224, the content of both of which is incorporated herein by reference in its entirety. In some embodiments, the PEG-DAA conjugate can be, for example, PEG-dilauryloxypropyl, PEG-dimyristyloxypropyl, PEG-dipalmityloxypropyl, or PEG-distearyloxypropyl. The PEG-lipid can be one or more of PEG-DMG, PEG-dilaurylglycerol, PEG-dipalmitoylglycerol, PEG-disterylglycerol, PEG-dilaurylglycamide, PEG-dimyristylglycamide, PEG-dipalmitoylglycamide, PEG-di sterylglycamide, PEG-cholesterol (1-[8'-(Cholest-5-en-3 [beta]-oxy)carboxamido-3',6'-dioxaoctanyl] carbamoyl-[omega]-methyl-poly(ethylene glycol), PEG-DMB (3,4-Ditetradecoxylbenzyl-[omega]-methyl-poly(ethylene glycol) ether), and 1,2-dimyristoyl-sn-glycero-3-phosphoethanolamine-N-[methoxy(polyethylene glycol)-2000]. In some embodiments, the PEG-lipid comprises PEG-DMG, 1,2-dimyristoyl-sn-glycero-3-phosphoethanolamine-N-[methoxy(polyethylene glycol)-2000]. In some embodiments, the PEG-lipid comprises a structure selected from:

(xxii)

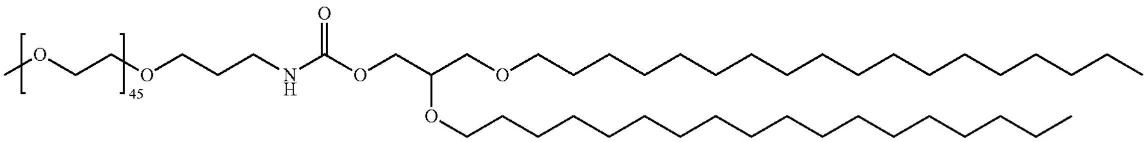

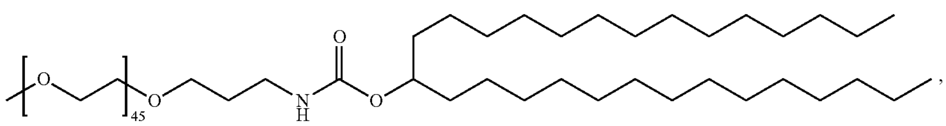, (xxiii)

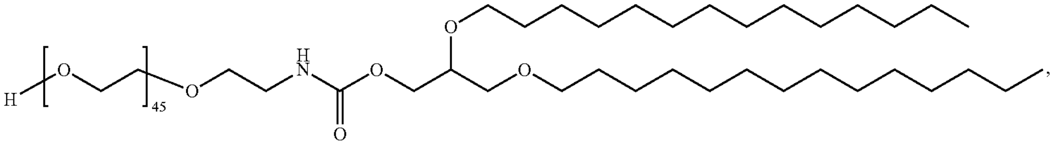,

-continued (xxiv)

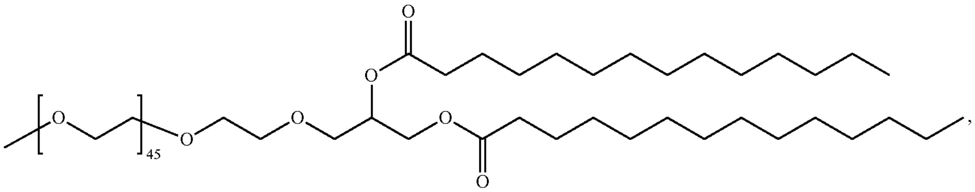

, and (xxv)

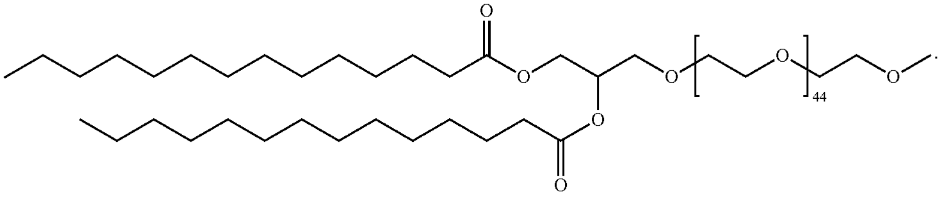

In some embodiments, lipids conjugated with a molecule other than a PEG can also be used in place of PEG-lipid. For example, polyoxazoline (POZ)-lipid conjugates, polyamide-lipid conjugates (such as ATTA-lipid conjugates), and cationic-polymer lipid (GPL) conjugates can be used in place of or in addition to the PEG-lipid.

Exemplary conjugated lipids, i.e., PEG-lipids, (POZ)-lipid conjugates, ATTA-lipid conjugates and cationic polymer-lipids are described in the PCT and LIS patent applications listed in Table 2 of WO2019051289A9 and in WO2020106946A1, the contents of all of which are incorporated herein by reference in their entirety.

In some embodiments an LNP comprises a compound of Formula (xix), a compound of Formula (xxi) and a compound of Formula (xxv). In some embodiments an LNP comprising a formulation of Formula (xix), Formula (xxi) and Formula (xxv) is used to deliver a gene modifying composition described herein to the lung or pulmonary cells.

In some embodiments, a lipid nanoparticle may comprise one or more cationic lipids selected from Formula (i), Formula (ii), Formula (iii), Formula (vii), and Formula (ix). In some embodiments, the LNP may further comprise one or more neutral lipid, e.g., DSPC, DPPC, DMPC, DOPC, POPC, DOPE, SM, a steroid, e.g., cholesterol, and/or one or more polymer conjugated lipid, e.g., a pegylated lipid, e.g., PEG-DAG, PEG-PE, PEG-S-DAG, PEG-cer or a PEG dialkyoxypropylcarbamate.

In some embodiments, the PEG or the conjugated lipid can comprise 0-20% (mol) of the total lipid present in the lipid nanoparticle. In some embodiments, PEG or the conjugated lipid content is 0.5-10% or 2-5% (mol) of the total lipid present in the lipid nanoparticle. Molar ratios of the ionizable lipid, non-cationic-lipid, sterol, and PEG/conjugated lipid can be varied as needed. For example, the lipid particle can comprise 30-70% ionizable lipid by mole or by total weight of the composition, 0-60% cholesterol by mole or by total weight of the composition, 0-30% non-cationic-lipid by mole or by total weight of the composition and 1-10% conjugated lipid by mole or by total weight of the composition. Preferably, the composition comprises 30-40% ionizable lipid by mole or by total weight of the composition, 40-50% cholesterol by mole or by total weight of the composition, and 10-20% non-cationic-lipid by mole or by total weight of the composition. In some other embodiments, the composition is 50-75% ionizable lipid by mole or by total weight of the composition, 20-40% cholesterol by mole or by total weight of the composition, and 5 to 10% non-cationic-lipid, by mole or by total weight of the composition and 1-10% conjugated lipid by mole or by total weight of the composition. The composition may contain 60-70% ionizable lipid by mole or by total weight of the composition, 25-35% cholesterol by mole or by total weight of the composition, and 5-10% non-cationic-lipid by mole or by total weight of the composition. The composition may also contain up to 90% ionizable lipid by mole or by total weight of the composition and 2 to 15% non-cationic lipid by mole or by total weight of the composition. The formulation may also be a lipid nanoparticle formulation, for example comprising 8-30% ionizable lipid by mole or by total weight of the composition, 5-30% non-cationic lipid by mole or by total weight of the composition, and 0-20% cholesterol by mole or by total weight of the composition; 4-25% ionizable lipid by mole or by total weight of the composition, 4-25% non-cationic lipid by mole or by total weight of the composition, 2 to 25% cholesterol by mole or by total weight of the composition, 10 to 35% conjugate lipid by mole or by total weight of the composition, and 5% cholesterol by mole or by total weight of the composition; or 2-30% ionizable lipid by mole or by total weight of the composition, 2-30% non-cationic lipid by mole or by total weight of the composition, 1 to 15% cholesterol by mole or by total weight of the composition, 2 to 35% conjugate lipid by mole or by total weight of the composition, and 1-20% cholesterol by mole or by total weight of the composition; or even up to 90% ionizable lipid by mole or by total weight of the composition and 2-10% non-cationic lipids by mole or by total weight of the composition, or even 100% cationic lipid by mole or by total weight of the composition. In some embodiments, the lipid particle formulation comprises ionizable lipid, phospholipid, cholesterol and a PEG-ylated lipid in a molar ratio of 50:10:38.5:1.5. In some other embodiments, the lipid particle formulation comprises ionizable lipid, cholesterol and a PEG-ylated lipid in a molar ratio of 60:38.5:1.5.

In some embodiments, the lipid particle comprises ionizable lipid, non-cationic lipid (e.g. phospholipid), a sterol (e.g., cholesterol) and a PEG-ylated lipid, where the molar ratio of lipids ranges from 20 to 70 mole percent for the ionizable lipid, with a target of 40-60, the mole percent of non-cationic lipid ranges from 0 to 30, with a target of 0 to 15, the mole percent of sterol ranges from 20 to 70, with a target of 30 to 50, and the mole percent of PEG-ylated lipid ranges from 1 to 6, with a target of 2 to 5.

In some embodiments, the lipid particle comprises ionizable lipid/non-cationic-lipid/sterol/conjugated lipid at a molar ratio of 50:10:38.5:1.5.

In an aspect, the disclosure provides a lipid nanoparticle formulation comprising phospholipids, lecithin, phosphatidylcholine and phosphatidylethanolamine.

In some embodiments, one or more additional compounds can also be included. Those compounds can be administered separately or the additional compounds can be included in the lipid nanoparticles of the invention. In other words, the lipid nanoparticles can contain other compounds in addition to the nucleic acid or at least a second nucleic acid, different than the first. Without limitations, other additional compounds can be selected from the group consisting of small or large organic or inorganic molecules, monosaccharides, disaccharides, trisaccharides, oligosaccharides, polysaccharides, peptides, proteins, peptide analogs and derivatives thereof, peptidomimetics, nucleic acids, nucleic acid analogs and derivatives, an extract made from biological materials, or any combinations thereof.

In some embodiments, a lipid nanoparticle (or a formulation comprising lipid nanoparticles) lacks reactive impurities (e.g., aldehydes or ketones), or comprises less than a preselected level of reactive impurities (e.g., aldehydes or ketones). While not wishing to be bound by theory, in some embodiments, a lipid reagent is used to make a lipid nanoparticle formulation, and the lipid reagent may comprise a contaminating reactive impurity (e.g., an aldehyde or ketone). A lipid regent may be selected for manufacturing based on having less than a preselected level of reactive impurities (e.g., aldehydes or ketones). Without wishing to be bound by theory, in some embodiments, aldehydes can cause modification and damage of RNA, e.g., cross-linking between bases and/or covalently conjugating lipid to RNA (e.g., forming lipid-RNA adducts). This may, in some instances, lead to failure of a reverse transcriptase reaction and/or incorporation of inappropriate bases, e.g., at the site(s) of lesion(s), e.g., a mutation in a newly synthesized target DNA.

In some embodiments, a lipid nanoparticle formulation is produced using a lipid reagent comprising less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, a lipid nanoparticle formulation is produced using a lipid reagent comprising less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, a lipid nanoparticle formulation is produced using a lipid reagent comprising: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, the lipid nanoparticle formulation is produced using a plurality of lipid reagents, and each lipid reagent of the plurality independently meets one or more criterion described in this paragraph. In some embodiments, each lipid reagent of the plurality meets the same criterion, e.g., a criterion of this paragraph.

In some embodiments, the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, the lipid nanoparticle formulation comprises: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

In some embodiments, one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, one or more, or optionally all, of the lipid reagents used for a lipid nanoparticle as described herein or a formulation thereof comprise: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

In some embodiments, total aldehyde content and/or quantity of any single reactive impurity (e.g., aldehyde) species is determined by liquid chromatography (LC), e.g., coupled with tandem mass spectrometry (MS/MS), e.g., according to the method described in Example 40 of PCT/US21/20948. In some embodiments, reactive impurity (e.g., aldehyde) content and/or quantity of reactive impurity (e.g., aldehyde) species is determined by detecting one or more chemical modifications of a nucleic acid molecule (e.g., an RNA molecule, e.g., as described herein) associated with the presence of reactive impurities (e.g., aldehydes), e.g., in the lipid reagents. In some embodiments, reactive impurity (e.g., aldehyde) content and/or quantity of reactive impurity (e.g., aldehyde) species is determined by detecting one or more chemical modifications of a nucleotide or nucleoside (e.g., a ribonucleotide or ribonucleoside, e.g., comprised in or isolated from a template nucleic acid, e.g., as described herein) associated with the presence of reactive impurities (e.g., aldehydes), e.g., in the lipid reagents, e.g., according to the method described in Example 41 of PCT/US21/20948. In embodiments, chemical modifications of a nucleic acid molecule, nucleotide, or nucleoside are detected by determining the presence of one or more modified nucleotides or nucleosides, e.g., using LC-MS/MS analysis, e.g., according to the method described in Example 41 of PCT/US21/20948.

In some embodiments, a nucleic acid (e.g., RNA) described herein (e.g., a template nucleic acid or a nucleic acid encoding a gene modifying polypeptide) does not comprise an aldehyde modification, or comprises less than a preselected amount of aldehyde modifications. In some embodiments, on average, a nucleic acid has less than 50, 20, 10, 5, 2, or 1 aldehyde modifications per 1000 nucleotides, e.g., wherein a single cross-linking of two nucleotides is a single aldehyde modification. In some embodiments, the aldehyde modification is an RNA adduct (e.g., a lipid-RNA adduct). In some embodiments, the aldehyde-modified nucleotide is cross-linking between bases. In some embodiments, a nucleic acid (e.g., RNA) described herein comprises less than 50, 20, 10, 5, 2, or 1 cross-links between nucleotide.

In some embodiments, LNPs are directed to specific tissues by the addition of targeting domains. For example, biological ligands may be displayed on the surface of LNPs to enhance interaction with cells displaying cognate receptors, thus driving association with and cargo delivery to tissues wherein cells express the receptor. In some embodiments, the biological ligand may be a ligand that drives delivery to the liver, e.g., LNPs that display GalNAc result in delivery of nucleic acid cargo to hepatocytes that display asialoglycoprotein receptor (ASGPR). The work of Akinc et al. *Mol Ther* 18(7):1357-1364 (2010) teaches the conjugation of a trivalent GalNAc ligand to a PEG-lipid (GalNAc-PEG-DSG) to yield LNPs dependent on ASGPR for observable LNP cargo effect (see, e.g., FIG. 6 therein). Other ligand-displaying LNP formulations, e.g., incorporating folate, transferrin, or antibodies, are discussed in WO2017223135, which is incorporated herein by reference in its entirety, in addition to the references used therein, namely Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; and Peer and Lieberman, Gene Ther. 2011 18:1127-1133.

In some embodiments, LNPs are selected for tissue-specific activity by the addition of a Selective ORgan Targeting (SORT) molecule to a formulation comprising traditional components, such as ionizable cationic lipids, amphipathic phospholipids, cholesterol and poly(ethylene glycol) (PEG) lipids. The teachings of Cheng et al. Nat Nanotechnol 15(4):313-320 (2020) demonstrate that the addition of a supplemental "SORT" component precisely alters the in vivo RNA delivery profile and mediates tissue-specific (e.g., lungs, liver, spleen) gene delivery and editing as a function of the percentage and biophysical property of the SORT molecule.

In some embodiments, the LNPs comprise biodegradable, ionizable lipids. In some embodiments, the LNPs comprise (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate) or another ionizable lipid. See, e.g, lipids of WO2019/067992, WO/2017/173054, WO2015/095340, and WO2014/136086, as well as references provided therein. In some embodiments, the term cationic and ionizable in the context of LNP lipids is interchangeable, e.g., wherein ionizable lipids are cationic depending on the pH.

In some embodiments, an LNP described herein comprises a lipid described in Table 19.

TABLE 19

Exemplary Lipids

| LIPID ID | Chemical Name | Molecular Weight | Structure |
|---|---|---|---|
| LIPIDV-003 | (9Z,12Z)-3-((4,4-bis(octyloxy) butanoyl)oxy)-2-((((3-(diethylamino) propoxy)carbonyl) oxy)methyl) propyl octadeca-9, 12-dienoate | 852.29 | 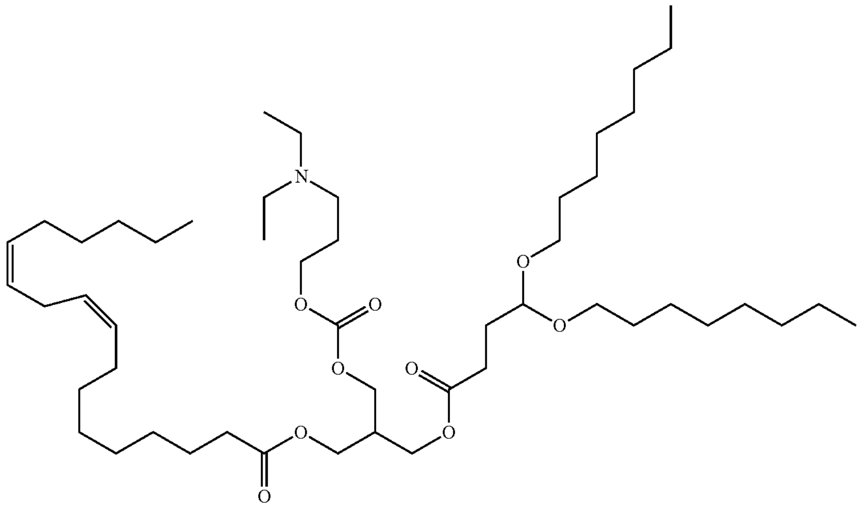 [SMILES: CCCCC/C=C\C/C=C\CCCCCCCC(=O)OCC(COC(=O)CCC(OCCCCCCCC)OCCCCCCCC)COC(=O)OCCCN(CC)CC] |
| LIPIDV-004 | Heptadecan-9-yl 8-((2-hydroxyethyl) (8-(nonyloxy)-8-oxooctyl) amino)octanoate | 710.18 | 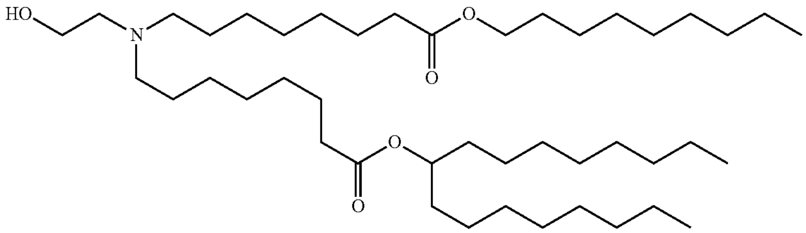 [SMILES: CCCCCCCCCOC(=O)CCCCCCCN(CCO)CCCCCCCC(=O)OC(CCCCCCCC)CCCCCCCC] |

TABLE 19-continued

| Exemplary Lipids | | | |
|---|---|---|---|
| LIPID ID | Chemical Name | Molecular Weight | Structure |
| LIPIDV-005 | | 919.56 | 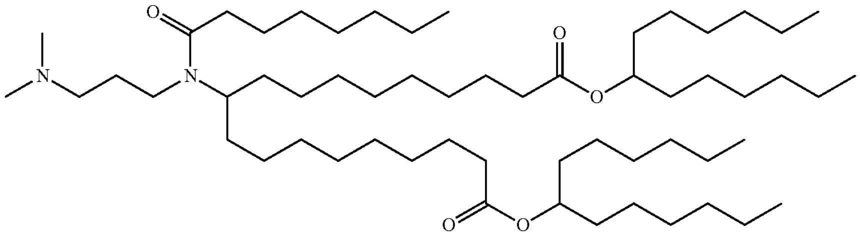 [SMILES: CCCCCCCC(=O)N(CCCN(C)C)C(CCCCCCCCC(=O)OC(CCCCCC)CCCCCC)CCCCCCCCC(=O)OC(CCCCCC)CCCCCC] |

In some embodiments, multiple components of a gene modifying system may be prepared as a single LNP formulation, e.g., an LNP formulation comprises mRNA encoding for the gene modifying polypeptide and an RNA template. Ratios of nucleic acid components may be varied in order to maximize the properties of a therapeutic. In some embodiments, the ratio of RNA template to mRNA encoding a gene modifying polypeptide is about 1:1 to 100:1, e.g., about 1:1 to 20:1, about 20:1 to 40:1, about 40:1 to 60:1, about 60:1 to 80:1, or about 80:1 to 100:1, by molar ratio. In other embodiments, a system of multiple nucleic acids may be prepared by separate formulations, e.g., one LNP formulation comprising a template RNA and a second LNP formulation comprising an mRNA encoding a gene modifying polypeptide. In some embodiments, the system may comprise more than two nucleic acid components formulated into LNPs. In some embodiments, the system may comprise a protein, e.g., a gene modifying polypeptide, and a template RNA formulated into at least one LNP formulation.

In some embodiments, the average LNP diameter of the LNP formulation may be between 10s of nm and 100s of nm, e.g., measured by dynamic light scattering (DLS). In some embodiments, the average LNP diameter of the LNP formulation may be from about 40 nm to about 150 nm, such as about 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, or 150 nm. In some embodiments, the average LNP diameter of the LNP formulation may be from about 50 nm to about 100 nm, from about 50 nm to about 90 nm, from about 50 nm to about 80 nm, from about 50 nm to about 70 nm, from about 50 nm to about 60 nm, from about 60 nm to about 100 nm, from about 60 nm to about 90 nm, from about 60 nm to about 80 nm, from about 60 nm to about 70 nm, from about 70 nm to about 100 nm, from about 70 nm to about 90 nm, from about 70 nm to about 80 nm, from about 80 nm to about 100 nm, from about 80 nm to about 90 nm, or from about 90 nm to about 100 nm. In some embodiments, the average LNP diameter of the LNP formulation may be from about 70 nm to about 100 nm. In a particular embodiment, the average LNP diameter of the LNP formulation may be about 80 nm. In some embodiments, the average LNP diameter of the LNP formulation may be about 100 nm. In some embodiments, the average LNP diameter of the LNP formulation ranges from about 1 mm to about 500 mm, from about 5 mm to about 200 mm, from about 10 mm to about 100 mm, from about 20 mm to about 80 mm, from about 25 mm to about 60 mm, from about 30 mm to about 55 mm, from about 35 mm to about 50 mm, or from about 38 mm to about 42 mm.

An LNP may, in some instances, be relatively homogenous. A polydispersity index may be used to indicate the homogeneity of an LNP, e.g., the particle size distribution of the lipid nanoparticles. A small (e.g., less than 0.3) polydispersity index generally indicates a narrow particle size distribution. An LNP may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of an LNP may be from about 0.10 to about 0.20.

The zeta potential of an LNP may be used to indicate the electrokinetic potential of the composition. In some embodiments, the zeta potential may describe the surface charge of an LNP. Lipid nanoparticles with relatively low charges, positive or negative, are generally desirable, as more highly charged species may interact undesirably with cells, tissues, and other elements in the body. In some embodiments, the zeta potential of an LNP may be from about −10 mV to about +20 mV, from about −10 mV to about +15 mV, from about −10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV.

The efficiency of encapsulation of a protein and/or nucleic acid, e.g., gene modifying polypeptide or mRNA encoding the polypeptide, describes the amount of protein and/or nucleic acid that is encapsulated or otherwise associated with an LNP after preparation, relative to the initial amount provided. The encapsulation efficiency is desirably high (e.g., close to 100%). The encapsulation efficiency may be measured, for example, by comparing the amount of protein or nucleic acid in a solution containing the lipid nanoparticle before and after breaking up the lipid nanoparticle with one or more organic solvents or detergents. An anion exchange resin may be used to measure the amount of free protein or nucleic acid (e.g., RNA) in a solution. Fluorescence may be used to measure the amount of free protein and/or nucleic acid (e.g., RNA) in a solution. For the lipid nanoparticles described herein, the encapsulation efficiency of a protein and/or nucleic acid may be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In some embodiments, the encapsulation efficiency may be at least 90%. In some embodiments, the encapsulation efficiency may be at least 95%.

An LNP may optionally comprise one or more coatings. In some embodiments, an LNP may be formulated in a capsule, film, or table having a coating. A capsule, film, or tablet including a composition described herein may have any useful size, tensile strength, hardness or density.

Additional exemplary lipids, formulations, methods, and characterization of LNPs are taught by WO2020061457, which is incorporated herein by reference in its entirety.

In some embodiments, in vitro or ex vivo cell lipofections are performed using Lipofectamine MessengerMax (Thermo Fisher) or TransIT-mRNA Transfection Reagent (Minis Bio). In certain embodiments, LNPs are formulated using the GenVoy_ILM ionizable lipid mix (Precision NanoSystems). In certain embodiments, LNPs are formulated using 2,2-dilinoleyl-4-dimethylaminoethyl-[1,3]-dioxolane (DLin-KC2-DMA) or dilinoleylmethyl-4-dimethylaminobutyrate (DLin-MC3-DMA or MC3), the formulation and in vivo use of which are taught in Jayaraman et al. Angew Chem Int Ed Engl 51(34):8529-8533 (2012), incorporated herein by reference in its entirety.

LNP formulations optimized for the delivery of CRISPR-Cas systems, e.g., Cas9-gRNA RNP, gRNA, Cas9 mRNA, are described in WO2019067992 and WO2019067910, both incorporated by reference.

Additional specific LNP formulations useful for delivery of nucleic acids are described in U.S. Pat. Nos. 8,158,601 and 8,168,775, both incorporated by reference, which include formulations used in patisiran, sold under the name ONPATTRO.

Exemplary dosing of gene modifying LNP may include about 0.1, 0.25, 0.3, 0.5, 1, 2, 3, 4, 5, 6, 8, 10, or 100 mg/kg (RNA). Exemplary dosing of AAV comprising a nucleic acid encoding one or more components of the system may include an MOI of about $10^{11}$, $10^{12}$, $10^{13}$, and $10^{14}$ vg/kg.

Kits, Articles of Manufacture, and Pharmaceutical Compositions

In an aspect the disclosure provides a kit comprising a gene modifying polypeptide or a gene modifying system, e.g., as described herein. In some embodiments, the kit comprises a gene modifying polypeptide (or a nucleic acid encoding the polypeptide) and a template RNA (or DNA encoding the template RNA). In some embodiments, the kit further comprises a reagent for introducing the system into a cell, e.g., transfection reagent, LNP, and the like. In some embodiments, the kit is suitable for any of the methods described herein. In some embodiments, the kit comprises one or more elements, compositions (e.g., pharmaceutical compositions), gene modifying polypeptides, and/or gene modifying systems, or a functional fragment or component thereof, e.g., disposed in an article of manufacture. In some embodiments, the kit comprises instructions for use thereof.

In an aspect, the disclosure provides an article of manufacture, e.g., in which a kit as described herein, or a component thereof, is disposed.

In an aspect, the disclosure provides a pharmaceutical composition comprising a gene modifying polypeptide or a gene modifying system, e.g., as described herein. In some embodiments, the pharmaceutical composition further comprises a pharmaceutically acceptable carrier or excipient. In some embodiments, the pharmaceutical composition comprises a template RNA and/or an RNA encoding the polypeptide. In embodiments, the pharmaceutical composition has one or more (e.g., 1, 2, 3, or 4) of the following characteristics:

(a) less than 1% (e.g., less than 0.5%, 0.4%, 0.3%, 0.2%, or 0.1%) DNA template relative to the template RNA and/or the RNA encoding the polypeptide, e.g., on a molar basis;

(b) less than 1% (e.g., less than 0.5%, 0.4%, 0.3%, 0.2%, or 0.1%) uncapped RNA relative to the template RNA and/or the RNA encoding the polypeptide, e.g., on a molar basis;

(c) less than 1% (e.g., less than 0.5%, 0.4%, 0.3%, 0.2%, or 0.1%) partial length RNAs relative to the template RNA and/or the RNA encoding the polypeptide, e.g., on a molar basis;

(d) substantially lacks unreacted cap dinucleotides.

Chemistry, Manufacturing, and Controls (CMC)

Purification of protein therapeutics is described, for example, in Franks, Protein Biotechnology: *Isolation, Characterization, and Stabilization*, Humana Press (2013); and in Cutler, *Protein Purification Protocols* (*Methods in Molecular Biology*), Humana Press (2010).

In some embodiments, a gene modifying system, polypeptide, and/or template nucleic acid (e.g., template RNA) conforms to certain quality standards. In some embodiments, a gene modifying system, polypeptide, and/or template nucleic acid (e.g., template RNA) produced by a method described herein conforms to certain quality standards. Accordingly, the disclosure is directed, in some aspects, to methods of manufacturing a gene modifying system, polypeptide, and/or template nucleic acid (e.g., template RNA) that conforms to certain quality standards, e.g., in which said quality standards are assayed. The disclosure is also directed, in some aspects, to methods of assaying said quality standards in a gene modifying system, polypeptide, and/or template nucleic acid (e.g., template RNA). In some embodiments, quality standards include, but are not limited to, one or more (e.g., 1, 2, 3, 4, 5, 6, 7, 8, 9, 10, 11, or 12) of the following:

(i) the length of the template RNA, e.g., whether the template RNA has a length that is above a reference length or within a reference length range, e.g., whether at least 80%, 85%, 90%, 95%, 96%, 97%, 98%, or 99% of the template RNA present is greater than 100, 125, 150, 175, or 200 nucleotides long;

(ii) the presence, absence, and/or length of a polyA tail on the template RNA, e.g., whether at least 80%, 85%, 90%, 95%, 96%, 97%, 98%, or 99% of the template RNA present contains a polyA tail (e.g., a polyA tail that is at least 5, 10, 20, 30, 50, 70, 100 nucleotides in length (SEQ ID NO: 37640));

(iii) the presence, absence, and/or type of a 5' cap on the template RNA, e.g., whether at least 80%, 85%, 90%, 95%, 96%, 97%, 98%, or 99% of the template RNA present contains a 5' cap, e.g., whether that cap is a 7-methylguanosine cap, e.g., a O-Me-m7G cap;

(iv) the presence, absence, and/or type of one or more modified nucleotides (e.g., selected from pseudouridine, dihydrouridine, inosine, 7-methylguanosine, 1-N-methylpseudouridine (1-5-methoxyuridine (5-MO-U), 5-methylcytidine (5mC), or a locked nucleotide) in the template RNA, e.g., whether at least 80%, 85%, 90%, 95%, 96%, 97%, 98%, or 99% of the template RNA present contains one or more modified nucleotides;

(v) the stability of the template RNA (e.g., over time and/or under a pre-selected condition), e.g., whether at least 80%, 85%, 90%, 95%, 96%, 97%, 98%, or 99% of the template RNA remains intact (e.g., greater than 100, 125, 150, 175, or 200 nucleotides long) after a stability test;

(vi) the potency of the template RNA in a system for modifying DNA, e.g., whether at least 1% of target sites are modified after a system comprising the template RNA is assayed for potency;

(vii) the length of the polypeptide, first polypeptide, or second polypeptide, e.g., whether the polypeptide, first polypeptide, or second polypeptide has a length that is above a reference length or within a reference length range, e.g., whether at least 80%, 85%, 90%, 95%, 96%, 97%, 98%, or 99% of the polypeptide, first polypeptide, or second polypeptide present is greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long);

(viii) the presence, absence, and/or type of post-translational modification on the polypeptide, first polypeptide, or second polypeptide, e.g., whether at least 80, 85, 90, 95, 96, 97, 98, or 99% of the polypeptide, first polypeptide, or second polypeptide contains phosphorylation, methylation, acetylation, myristoylation, palmitoylation, isoprenylation, glipyatyon, or lipoylation, or any combination thereof;

(ix) the presence, absence, and/or type of one or more artificial, synthetic, or non-canonical amino acids (e.g., selected from ornithine, (3-alanine, GABA, 6-Aminolevulinic acid, PABA, a D-amino acid (e.g., D-alanine or D-glutamate), aminoisobutyric acid, dehydroalanine, cystathionine, lanthionine, Djenkolic acid, Diaminopimelic acid, Homoalanine, Norvaline, Norleucine, Homonorleucine, homoserine, O-methyl-homoserine and O-ethyl-homoserine, ethionine, selenocysteine, selenohomocysteine, selenomethionine, selenoethionine, tellurocysteine, or telluromethionine) in the polypeptide, first polypeptide, or second polypeptide, e.g., whether at least 80%, 85%, 90%, 95%, 96%, 97%, 98%, or 99% of the polypeptide, first polypeptide, or second polypeptide present contains one or more artificial, synthetic, or non-canonical amino acids;

(x) the stability of the polypeptide, first polypeptide, or second polypeptide (e.g., over time and/or under a pre-selected condition), e.g., whether at least 80%, 85%, 90%, 95%, 96%, 97%, 98%, or 99% of the polypeptide, first polypeptide, or second polypeptide remains intact (e.g., greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long)) after a stability test;

(xi) the potency of the polypeptide, first polypeptide, or second polypeptide in a system for modifying DNA, e.g., whether at least 1% of target sites are modified after a system comprising the polypeptide, first polypeptide, or second polypeptide is assayed for potency; or (xii) the presence, absence, and/or level of one or more of a pyrogen, virus, fungus, bacterial pathogen, or host cell protein, e.g., whether the system is free or substantially free of pyrogen, virus, fungus, bacterial pathogen, or host cell protein contamination.

In some embodiments, a system or pharmaceutical composition described herein is endotoxin free.

In some embodiments, the presence, absence, and/or level of one or more of a pyrogen, virus, fungus, bacterial pathogen, and/or host cell protein is determined. In embodiments, whether the system is free or substantially free of pyrogen, virus, fungus, bacterial pathogen, and/or host cell protein contamination is determined.

In some embodiments, a pharmaceutical composition or system as described herein has one or more (e.g., 1, 2, 3, or 4) of the following characteristics:

(a) less than 1% (e.g., less than 0.5%, 0.4%, 0.3%, 0.2%, or 0.1%) DNA template relative to the template RNA and/or the RNA encoding the polypeptide, e.g., on a molar basis;

(b) less than 1% (e.g., less than 0.5%, 0.4%, 0.3%, 0.2%, or 0.1%) uncapped RNA relative to the template RNA and/or the RNA encoding the polypeptide, e.g., on a molar basis;

(c) less than 1% (e.g., less than 0.5%, 0.4%, 0.3%, 0.2%, or 0.1%) partial length RNAs relative to the template RNA and/or the RNA encoding the polypeptide, e.g., on a molar basis;

(d) substantially lacks unreacted cap dinucleotides.

EXAMPLES

Example 1: Screening Configurations of Template RNAs that Correct the R408W Mutation in a Genomic Landing Pad in Human Cells This example describes the use of gene modifying system containing a gene modifying polypeptide and template RNAs comprising varied lengths of heterologous object sequences and PBS sequences to quantify the activity of template RNAs for correction of the R408W mutation. In this example, a template RNA contains:

(1) a gRNA spacer;

(2) a gRNA scaffold;

(3) a heterologous object sequence; and (4) a primer binding site (PBS) sequence.

One or more template RNAs described in Tables 1A-4D can be tested as described in this example. The heterologous object sequences and PBS sequences were designed to correct the PAH mutation in a landing pad by replacing a "T" nucleotide with a "C" nucleotide at the mutation site via gene editing, to reverse a R408W mutation in the corresponding protein.

A cell line is created to have a "landing pad" or a stable integration that mimics a region of the PAH gene that contains the R408W mutation site and flanking sequences. The DNA for the landing pad is chemically synthesized and cloned into the pLenti-N-tGFP vector. The cloned landing pad sequence in the lentiviral expression vector is confirmed and the sequence is verified by Sanger sequencing of the landing pad. The sequence verified plasmids (9 μg) along with the lentiviral packaging mix (9 μg, Biosettia) are transfected using Lipofectamine2000™ according to the manufacturer instructions into a packaging cell line, LentiX-293T (Takara Bio). The transfected cells are incubated at 37° C., 5% $CO_2$ for 48 hours (including one medium change at 24 hrs) and the viral particle containing medium is collected from the cell culture dish. The collected medium is filtered through a 0.2 μm filter to remove cell debris and is prepared for transduction of HEK293T cells. The virus-containing medium is diluted in DMEM and mixed with polybrene to prepare a dilution series for transduction of HEK293T cells where the final concentration of polybrene is 8 μg/ml. The HEK293T cells are grown in virus containing medium for 48 hours and then split with fresh medium. The split cells are grown to confluence and transduction efficiency of the different dilutions of virus is measured by GFP expression via flow cytometry and ddPCR detection of the genomic integrated lentivirus that contained GFP and the PAH landing pads.

A gene modifying system comprising a (i) compatible gene modifying polypeptide described herein, e.g., having: an NLS of Table 11, a compatible Cas9 domain having a sequence of Table 8 (e.g., SpyCas9-SpRY), a linker of Table 10, an RT sequence of Table 6 (e.g., MLVMS_P03355_PLV919), and a second NLS of Table 11 and (ii) a template RNA of any of Tables 1A-4D (e.g., a template RNA of ID #1) is transfected into the HEK293T landing pad cell line. The gene modifying polypeptide and the template RNAs are delivered by nucleofection in RNA format. Specifically, 1 μg of gene modifying polypeptide mRNA is combined with 10 μM template RNAs. The mRNA and template RNAs are added to 25 μL SF buffer containing 250,000 HEK293T landing pad cells and cells are nucleofected using program DS-150. After nucleofection, are were grown at 37° C., 5% $CO_2$ for 3 days prior to cell lysis and genomic DNA extraction. To analyze gene editing activity, primers flanking the PAH mutation site are used to amplify across the locus. Amplicons are analyzed via short read sequencing using an Illumina MiSeq. In some embodiments, the assay will indicate that at least 5%, 10%, 20%, 30%, 40%, or 50% of copies of the PAH gene in the sample are converted to the desired wild-type sequence.

Example 2: Gene Modifying Polypeptide Selection by Pooled Screening in HEK293T & U2OS Cells This example describes the use of an RNA gene modifying system for the targeted editing of a coding sequence in the human genome. More specifically, this example describes the infection of HEK293T and U2OS cells with a library of gene modifying candidates, followed by transfection of a template guide RNA (tgRNA) for in vitro gene modifying in the cells, e.g., as a means of evaluating a new gene modifying polypeptide for editing activity in human cells by a pooled screening approach.

The gene modifying polypeptide library candidates assayed herein each comprise: 1) a *S. pyogenes* (Spy) Cas9 nickase containing an N863A mutation that inactivates one endonuclease active site; 2) one of the 122 peptide linkers depicted at Table 10; and 3) a reverse transcriptase (RT) domain from Table 6 of retroviral origin. The particular retroviral RT domains utilized were selected if they were expected to function as a monomer. For each selected RT domain, the wild-type sequences were tested, as well as versions with point mutations installed in the primary wild-type sequence. In particular, 143 RT domains were tested, either wild type or containing various mutations. In total, 17,446 Cas-linker-RT gene modifying polypeptides were tested.

The system described here is a two-component system comprising: 1) an expression plasmid encoding a human codon-optimized gene modifying polypeptide library candidate within a lentiviral cassette, and 2) a tgRNA expression plasmid expressing a non-coding tgRNA sequence that is recognized by Cas and localizes it to the genomic locus of interest, and that also templates reverse transcription of the desired edit into the genome by the RT domain, driven by a U6 promoter. The lentiviral cassette comprises: (i) a CMV promoter for expression in mammalian cells; (ii) a gene modifying polypeptide library candidate as shown; (iii) a self-cleaving T2A polypeptide; (iv) a puromycin resistance gene enabling selection in mammalian cells; and (v) a polyA tail termination signal.

To prepare a pool of cells expressing gene modifying polypeptide library candidates, HEK293T or U2OS cells were transduced with pooled lentiviral preparations of the gene modifying candidate plasmid library. HEK293 Lenti-X cells were seeded in 15 cm plates (12×10$^6$ cells) prior to lentiviral plasmid transfection. Lentiviral plasmid transfection using the Lentiviral Packaging Mix (Biosettia, 27 ug) and the plasmid DNA for the gene modifying candidate library (27 ug) was performed the following day using Lipofectamine 2000 and Opti-MEM media according to the manufacturer's protocol. Extracellular DNA was removed by a full media change the next day and virus-containing media was harvested 48 hours after. Lentiviral media was concentrated using Lenti-X Concentrator (TaKaRa Biosciences) and 5 mL lentiviral aliquots were made and stored at −80° C. Lentiviral titering was performed by enumerating colony forming units post Puromycin selection. HEK293T or U2OS cells carrying a BFP-expressing genomic landing pad were seeded at 6×10$^7$ cells in culture plates and transduced at a 0.3 multiplicity of infection (MOI) to minimize multiple infections per cell. Puromycin (2.5 ug/mL) was added 48 hours post infection to allow for selection of infected cells. Cells were kept under puromycin selection for at least 7 days and then scaled up for tgRNA electroporation.

To determine the genome-editing capacity of the gene modifying library candidates in the assay, infected BFP-expressing HEK293T or U2OS cells were then transfected by electroporation of 250,000 cells/well with 200 ng of a tgRNA (either g4 or g10) plasmid, designed to convert BFP to GFP, at sufficient cell count for >1000× coverage per library candidate.

The g4 tgRNA (5' to 3') is as follows: 20 nucleotide spacer region (GCCGAAGCACTGCACGCCGT; SEQ ID NO: 11,011), a scaffold region (GTTTTAGAGCTAGAAATAGCAAGTTAAAATAAGGCTAGTCCGTTATCAACTTGAAAAAGTGGCACCGAGTCGGTGC; SEQ ID NO: 11,012), the template region encoding the single base pair substitution to change BFP to GFP (bold) and a PAM inactivation that introduces a synonymous point mutation in the SpyCas9 PAM (NGG to NCG) that prevents re-engagement of the gene modifying polypeptide upon completion of a functional gene modifying reaction (underline) (ACCCTGACGTACG; SEQ ID NO: 11,013), and the 13 nucleotide PBS (GCGTGCAGTGCTT; SEQ ID NO: 11,014).

Similarly, the g10 tgRNA (5' to 3') is as follows: 20 nucleotide spacer region (AGAAGTCGTGCTGCTTCATG; SEQ ID NO: 11,015), a scaffold region (GTTTTAGAGCTAGAAATAGCAAGTTAAAATAAGGCTAGTCCGTTATCAACTTGAAAAAGTGGCACCGAGTCGGTGC; SEQ ID NO: 11,016), the template region encoding the single base pair substitution to change BFP to GFP (bold) and a PAM inactivation that introduces a synonymous point mutation in the SpyCas9 PAM (NGG to NGA) that prevents re-engagement of the gene modifying polypeptide upon completion of a functional gene modifying reaction (underline) (ACCCTGACCTACGGCGTGCAGTGCTTCGGCCGCTACCCCGATCACAT; SEQ ID NO: 11,017), and 13 nucleotide PBS (GAAGCAGCACGAC; SEQ ID NO: 11,018).

To assess the genome-editing capacity of the various constructs in the assay, cells were sorted by Fluorescence-Activated Cell Sorting (FACS) for GFP expression 6-7 days post-electroporation. Cells were sorted and harvested as distinct populations of unedited (BFP+) cells, edited (GFP+) cells and imperfect edit (BFP−, GFP−) cells. A sample of unsorted cells was also harvested as the input population to determine enrichment during analysis.

To determine which gene modifying library candidates have genome-editing capacity in this assay, genomic DNA (gDNA) was harvested from sorted and unsorted cell populations, and analyzed by sequencing the gene modifying library candidates in each population. Briefly, gene modifying sequences were amplified from the genome using primers specific to the lentiviral cassette, amplified in a second round of PCR to dilute genomic DNA, and then sequenced using Oxford Nanopore Sequencing Technology according to the manufacturer's protocol.

After quality control of sequencing reads, reads of at least 1500 and no more than 3200 nucleotides were mapped to the gene modifying polypeptide library sequences and those containing a minimum of an 80% match to a library sequence were considered to be successfully aligned to a given candidate. To identify gene modifying candidates capable of performing gene editing in the assay, the read count of each library candidate in the edited population was compared to its read count in the initial, unsorted population. For purposes of this pooled screen, gene modifying candidates with genome-editing capacity were selected as those candidates that were enriched in the converted (GFP+) population relative to unsorted (input) cells and wherein the enrichment was determined to be at or above the enrichment level of a reference (Element ID No: 17380).

A large number of gene modifying polypeptide candidates were determined to be enriched in the GFP+ cell populations. For example, of the 17,446 candidates tested, over 3,300 exhibited enrichment in GFP+ sorted populations (relative to unsorted) that was at least equivalent to that of the reference under similar experimental conditions (HEK293T using g4 tgRNA; HEK293T cells using g10 tgRNA; or U2OS cells using g4 tgRNA), shown in Table D. Although the 17,446 candidates were also tested in U2OS cells using g10 tgRNA, the pooled screen did not yield candidates that were enriched in the converted (GFP+) population relative to unsorted (input) cells under that experimental condition; further investigation is required to explain these results.

TABLE D

Combinations of linker and RT sequences screened. The amino acid sequence of each RT in this table is provided in Table 6.

| Linker amino acid sequence | SEQ ID NO: | RT domain name |
|---|---|---|
| EAAAKGSS | 12,001 | PERV_Q4VFZ2_3mutA_WS |
| EAAAKEAAAKEAAAKEAAAK | 12,002 | MLVMS_P03355_PLV919 |
| PAPEAAAK | 12,003 | MLVFF_P26809_3mutA |
| EAAAKPAPGGG | 12,004 | MLVFF_P26809_3mutA |
| GSSGSSGSSGSSGSSGSS | 12,005 | PERV_Q4VFZ2_3mut |
| PAPGGGEAAAK | 12,006 | MLVAV_P03356_3mutA |
| AEAAAKEAAAKEAAAKEAAAKALEAEAAAKEAAAKEAAAKEAAAKA | 12,007 | MLVMS_P03355_PLV919 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSEAAAK | 12,008 | MLVFF_P26809_3mutA |
| EAAAKPAPGGS | 12,009 | MLVFF_P26809_3mutA |
| GGSGGSGGSGGSGGSGGS | 12,010 | MLVFF_P26809_3mutA |
| AEAAAKEAAAKEAAAKEAAAKALEAEAAAKEAAAKEAAAKEAAAKA | 12,011 | XMRV6_A1Z651_3mutA |
| AEAAAKEAAAKEAAAKEAAAKALEAEAAAKEAAAKEAAAKEAAAKA | 12,012 | PERV_Q4VFZ2_3mutA_WS |
| EAAAKEAAAKEAAAK | 12,013 | MLVFF_P26809_3mutA |
| PAPEAAAKGSS | 12,014 | MLVFF_P26809_3mutA |
| AEAAAKEAAAKEAAAKEAAAKALEAEAAAKEAAAKEAAAKEAAAKA | 12,015 | PERV_Q4VFZ2_3mutA_WS |
| EAAAKEAAAKEAAAK | 12,016 | PERV_Q4VFZ2_3mutA_WS |
| AEAAAKEAAAKEAAAKEAAAKALEAEAAAKEAAAKEAAAKEAAAKA | 12,017 | AVIRE_P03360_3mutA |
| PAPAPAPAPAP | 12,018 | MLVCB_P08361_3mutA |
| PAPAPAPAPAP | 12,019 | MLVFF_P26809_3mutA |
| EAAAKGGSPAP | 12,020 | PERV_Q4VFZ2_3mutA_WS |
| PAP | | MLVMS_P03355_PLV919 |
| PAPGGGGSS | 12,022 | WMSV_P03359_3mutA |
| SGSETPGTSESATPES | 12,023 | MLVFF_P26809_3mutA |
| PAPEAAAKGSS | 12,024 | XMRV6_A1Z651_3mutA |
| EAAAKGGSGGG | 12,025 | MLVMS_P03355_PLV919 |
| GGGGSGGGGS | 12,026 | MLVFF_P26809_3mutA |
| GGGPAPGSS | 12,027 | MLVAV_P03356_3mutA |
| GGSGGSGGSGGSGGSGGS | 12,028 | XMRV6_A1Z651_3mut |
| GGGGSGGGGSGGGGSGGGGGGGGSGGGGS | 12,029 | MLVCB_P08361_3mutA |
| GSSPAP | 12,030 | AVIRE_P03360_3mutA |
| EAAAKGSSPAP | 12,031 | MLVFF_P26809_3mutA |
| GSSGGGEAAAK | 12,032 | MLVFF_P26809_3mutA |
| GGSGGSGGSGGSGGSGGS | 12,033 | MLVMS_P03355_3mutA_WS |
| PAPAPAPAP | 12,034 | MLVFF_P26809_3mutA |
| EAAAKEAAAKEAAAKEAAAK | 12,035 | XMRV6_A1Z651_3mutA |
| EAAAKGGSPAP | 12,036 | MLVMS_P03355_3mutA_WS |
| PAPGGSEAAAK | 12,037 | AVIRE_P03360_3mutA |
| GGGGSGGGGSGGGGSGGGGSGGGGSGGGGS | 12,038 | AVIRE_P03360_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKGGGGSEAAAK | 12,039 | MLVCB_P08361_3mutA |
| AEAAAKEAAAKEAAAKEAAAKALEAEAAAKEAAAKEAAAKEAAAKA | 12,040 | WMSV_P03359_3mutA |
| GSS | | MLVMS_P03355_PLV919 |
| GSSGSSGSSGSS | 12,042 | MLVMS_P03355_PLV919 |
| GSSPAPEAAAK | 12,043 | XMRV6_A1Z651_3mutA |
| GGSPAPEAAAK | 12,044 | MLVFF_P26809_3mutA |
| GGGEAAAKGGS | 12,045 | MLVFF_P26809_3mutA |
| EAAAKEAAAKEAAAKEAAAKEAAAK | 12,046 | PERV_Q4VFZ2_3mutA_WS |
| GGGGGGGG | 12,047 | PERV_Q4VFZ2_3mut |
| GGGPAP | 12,048 | MLVCB_P08361_3mutA |
| PAPAPAPAPAPAP | 12,049 | MLVCB_P08361_3mutA |
| GGSGGSGGSGGSGGSGGS | 12,050 | MLVCB_P08361_3mutA |
| PAP | | MLVMS_P03355_3mutA_WS |
| GGSGGSGGSGGSGGSGGS | 12,052 | PERV_Q4VFZ2_3mutA_WS |
| PAPAPAPAPAPAP | 12,053 | MLVMS_P03355_PLV919 |
| EAAAKPAPGSS | 12,054 | MLVMS_P03355_3mutA_WS |
| EAAAKEAAAKEAAAKEAAAK | 12,055 | MLVMS_P03355_3mutA_WS |
| EAAAKGGS | 12,056 | MLVMS_P03355_3mutA_WS |
| GGGGSEAAAKGGGGS | 12,057 | MLVFF_P26809_3mutA |
| EAAAKPAPGSS | 12,058 | MLVFF_P26809_3mutA |
| GGGGSGGGGGGGGSGGGGS | 12,059 | MLVMS_P03355_PLV919 |
| EAAAKGGGGGS | 12,060 | MLVMS_P03355_PLV919 |
| GGSPAP | 12,061 | XMRV6_A1Z651_3mutA |
| EAAAKGGGPAP | 12,062 | MLVMS_P03355_PLV919 |
| EAAAKEAAAKEAAAKEAAAKEAAAK | 12,063 | MLVFF_P26809_3mutA |
| PAP | | MLVCB_P08361_3mutA |
| EAAAK | 12,065 | XMRV6_A1Z651_3mutA |
| GGSGSSPAP | 12,066 | PERV_Q4VFZ2_3mutA_WS |
| GSSGSSGSSGSSGSSGSS | 12,067 | MLVMS_P03355_PLV919 |
| GSSEAAAKGGG | 12,068 | MLVAV_P03356_3mutA |
| GGGEAAAKGGS | 12,069 | XMRV6_A1Z651_3mutA |
| EAAAKGGGGSEAAAK | 12,070 | MLVAV_P03356_3mutA |
| GGGGSGGGGSGGGGS | 12,071 | MLVFF_P26809_3mutA |
| GGGGGGGGSGGGGSGGGGS | 12,072 | AVIRE_P03360_3mutA |
| SGSETPGTSESATPES | 12,073 | AVIRE_P03360_3mutA |
| GGGEAAAKPAP | 12,074 | MLVFF_P26809_3mutA |
| EAAAKGSSGGG | 12,075 | MLVMS_P03355_3mutA_WS |
| EAAAKEAAAKEAAAKEAAAKEAAAK | 12,076 | WMSV_P03359_3mut |
| GGSGGSGGSGGS | 12,077 | XMRV6_A1Z651_3mutA |
| GGSEAAAKPAP | 12,078 | MLVFF_P26809_3mutA |
| EAAAKGSSGGG | 12,079 | XMRV6_A1Z651_3mutA |
| GGGGS | 12,080 | MLVFF_P26809_3mutA |
| GGGEAAAKGSS | 12,081 | MLVMS_P03355_PLV919 |
| PAPAPAPAPAPAP | 12,082 | MLVAV_P03356_3mutA |
| GGGGSGGGGSGGGGSGGGGS | 12,083 | MLVCB_P08361_3mutA |
| GGGEAAAKGSS | 12,084 | MLVCB_P08361_3mutA |
| PAPGGSGSS | 12,085 | MLVFF_P26809_3mutA |
| GSAGSAAGSGEF | 12,086 | MLVCB_P08361_3mutA |
| PAPGGSEAAAK | 12,087 | MLVMS_P03355_3mutA_WS |
| GGSGSS | 12,088 | XMRV6_A1Z651_3mutA |
| PAPGGGGSS | 12,089 | MLVMS_P03355_PLV919 |
| GSSGSSGSS | 12,090 | XMRV6_A1Z651_3mut |
| AEAAAKEAAAKEAAAKEAAAKALEAEAAAKEAAAKEAAAKEAAAKA | 12,091 | MLVMS_P03355_3mutA_WS |
| EAAAK | 12,092 | MLVMS_P03355_PLV919 |
| GSSGSSGSSGSS | 12,093 | MLVFF_P26809_3mutA |
| PAPGGGGSS | 12,094 | MLVCB_P08361_3mutA |
| GGGEAAAKGGS | 12,095 | MLVCB_P08361_3mutA |
| PAPGGGEAAAK | 12,096 | MLVMS_P03355_PLV919 |
| GGGGGSPAP | 12,097 | XMRV6_A1Z651_3mutA |
| EAAAKGGS | 12,098 | XMRV6_A1Z651_3mutA |
| EAAAKGSSPAP | 12,099 | XMRV6_A1Z651_3mut |
| PAPEAAAK | 12,100 | MLVAV_P03356_3mutA |
| GGSGGSGGSGGS | 12,101 | MLVMS_P03355_3mutA_WS |
| GGGPAPGGS | 12,102 | MLVMS_P03355_PLV919 |
| GSSGSSGSSGSS | 12,103 | PERV_Q4VFZ2_3mutA_WS |
| EAAAKPAPGGS | 12,104 | MLVCB_P08361_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSGSS | 12,105 | MLVFF_P26809_3mutA |
| EAAAKEAAAKEAAAKEAAAK | 12,106 | MLVCB_P08361_3mutA |
| EAAAKEAAAKEAAAKEAAAK | 12,107 | FLV_P10273_3mutA |
| GSS | | MLVFF_P26809_3mutA |
| EAAAKEAAAK | 12,109 | MLVMS_P03355_3mutA_WS |
| PAPEAAAKGGG | 12,110 | MLVAV_P03356_3mutA |
| GGSGSSEAAAK | 12,111 | MLVFF_P26809_3mutA |
| EAAAKEAAAKEAAAKEAAAKEAAAK | 12,112 | PERV_Q4VFZ2 |
| GSSEAAAKPAP | 12,113 | AVIRE_P03360_3mutA |
| EAAAKEAAAKEAAAKEAAAKEAAAK | 12,114 | MLVCB_P08361_3mutA |
| EAAAKGGG | 12,115 | MLVFF_P26809_3mutA |
| GSSPAPGGG | 12,116 | MLVCB_P08361_3mutA |
| GGGPAPGSS | 12,117 | MLVMS_P03355_PLV919 |
| GGGGGS | 12,118 | MLVMS_P03355_3mutA_WS |
| EAAAKEAAAKEAAAKEAAAKEAAAKEAAAK | 12,119 | PERV_Q4VFZ2_3mut |
| GGGGSGGGGSGGGGSGGGGSGGGGS | 12,120 | WMSV_P03359_3mutA |
| EAAAKEAAAKEAAAK | 12,121 | PERV_Q4VFZ2_3mut |
| PAPAPAPAP | 12,122 | MLVCB_P08361_3mutA |
| GSSGSSGSSGSSGSS | 12,123 | PERV_Q4VFZ2_3mut |
| GGGGSSEAAAK | 12,124 | MLVMS_P03355_3mutA_WS |
| GGSGGSGGSGGS | 12,125 | MLVCB_P08361_3mutA |
| PAPEAAAKGGS | 12,126 | MLVCB_P08361_3mutA |
| EAAAKEAAAKEAAAKEAAAKEAAAKEAAAK | 12,127 | MLVCB_P08361_3mutA |
| EAAAKGGGGSEAAAK | 12,128 | MLVMS_P03355_PLV919 |
| EAAAKGGGGSEAAAK | 12,129 | MLVMS_P03355_3mutA_WS |
| EAAAKGGGPAP | 12,130 | XMRV6_A1Z651_3mut |
| EAAAKEAAAKEAAAKEAAAKEAAAK | 12,131 | MLVMS_P03355_3mutA_WS |
| AEAAAKEAAAKEAAAKEAAAKALEAEAAAKEAAAKEAAAKEAAAKA | 12,132 | FLV_P10273_3mutA |
| GGSEAAAKGGG | 12,133 | MLVMS_P03355_3mutA_WS |
| GGGGSGGGGSGGGGSGGGGSGGGGSGGGGS | 12,134 | KORV_Q9TTC1-Pro_3mutA |
| GGGPAPGGS | 12,135 | MLVCB_P08361_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| PAPAPAPAPAPAP | 12,136 | XMRV6_A1Z651_3mutA |
| GGSGSSGGG | 12,137 | XMRV6_A1Z651_3mutA |
| GGSGSSGGG | 12,138 | MLVCB_P08361_3mutA |
| GGGEAAAKGGS | 12,139 | MLVMS_P03355_3mutA_WS |
| EAAAK | 12,140 | MLVCB_P08361_3mutA |
| GGSPAPGSS | 12,141 | MLVMS_P03355_3mutA_WS |
| GGGGSSEAAAK | 12,142 | PERV_Q4VFZ2_3mut |
| PAPAPAPAPAP | 12,143 | MLVBM_Q7SVK7_3mut |
| EAAAKEAAAKEAAAKEAAAK | 12,144 | MLVAV_P03356_3mutA |
| GGGGGSGSS | 12,145 | MLVCB_P08361_3mutA |
| EAAAKGSSPAP | 12,146 | MLVMS_P03355_3mutA_WS |
| PAPAPAPAPAPAP | 12,147 | MLVMS_P03355_3mutA_WS |
| GSSGGGGGS | 12,148 | MLVMS_P03355_3mutA_WS |
| PAPGSSGGG | 12,149 | MLVMS_P03355_PLV919 |
| GGSGGGPAP | 12,150 | MLVCB_P08361_3mutA |
| GGGGGGG | 12,151 | MLVCB_P08361_3mutA |
| GSSGSSGSSGSSGSSGSS | 12,152 | MLVCB_P08361_3mutA |
| GGGPAPGGS | 12,153 | MLVFF_P26809_3mutA |
| EAAAKGGSGGG | 12,154 | PERV_Q4VFZ2_3mut |
| EAAAKGGGGSS | 12,155 | MLVMS_P03355_3mutA_WS |
| GSSGSSGSSGSSGSSGSS | 12,156 | MLVMS_P03355_3mut |
| GGGGSGGGGSGGGGSGGGGS | 12,157 | MLVBM_Q7SVK7_3mutA_WS |
| PAPAPAPAPAP | 12,158 | MLVMS_P03355_PLV919 |
| GGGEAAAKGGS | 12,159 | MLVMS_P03355_PLV919 |
| AEAAAKEAAAKEAAAKEAAAKALEAEAAAKEAAAKEAAAKEAAAKA | 12,160 | MLVMS_P03355_3mut |
| GSAGSAAGSGEF | 12,161 | MLVMS_P03355_3mutA_WS |
| GSSGSSGSSGSSGSS | 12,162 | MLVFF_P26809_3mutA |
| EAAAKGGSGSS | 12,163 | MLVFF_P26809_3mutA |
| PAPGGG | 12,164 | MLVFF_P26809_3mutA |
| GGGPAPGSS | 12,165 | XMRV6_A1Z651_3mutA |
| PAPEAAAKGGS | 12,166 | AVIRE_P03360_3mutA |
| PAPGGGEAAAK | 12,167 | MLVFF_P26809_3mut |
| GGGGSSEAAAK | 12,168 | MLVCB_P08361_3mutA |
| EAAAK | 12,169 | MLVMS_P03355_PLV919 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGGSGGGGSGGGGSGGGGSGGGGSGGGGS | 12,170 | BAEVM_P10272_3mutA |
| GGSGGGEAAAK | 12,171 | MLVMS_P03355_PLV919 |
| AEAAAKEAAAKEAAAKEAAAKALEAEAAAKEAAAKEAAAKEAAAKA | 12,172 | MLVFF_P26809_3mutA |
| GSSPAPGGS | 12,173 | XMRV6_A1Z651_3mutA |
| GGSGGGPAP | 12,174 | MLVMS_P03355_PLV919 |
| EAAAK | 12,175 | AVIRE_P03360_3mutA |
| GSS | | XMRV6_A1Z651_3mutA |
| GGSGGSGGS | 12,177 | MLVFF_P26809_3mutA |
| EAAAKEAAAKEAAAKEAAAK | 12,178 | AVIRE_P03360_3mut |
| PAPEAAAKGGG | 12,179 | PERV_Q4VFZ2_3mutA_WS |
| GGGGGSEAAAK | 12,180 | BAEVM_P10272_3mutA |
| GGSGSSGGG | 12,181 | MLVMS_P03355_3mutA_WS |
| GGGGGGG | 12,182 | MLVMS_P03355_3mutA_WS |
| GSSEAAAKPAP | 12,183 | PERV_Q4VFZ2_3mut |
| GGGGGSEAAAK | 12,184 | WMSV_P03359_3mut |
| GGGGSGGGGSGGGGSGGGGSGGGGGS | 12,185 | MLVFF_P26809_3mut |
| GGGEAAAKGGS | 12,186 | AVIRE_P03360_3mutA |
| GGSPAPGGG | 12,187 | AVIRE_P03360_3mutA |
| GSAGSAAGSGEF | 12,188 | MLVAV_P03356_3mutA |
| EAAAK | 12,189 | MLVAV_P03356_3mutA |
| EAAAKPAPGSS | 12,190 | WMSV_P03359_3mutA |
| EAAAKEAAAKEAAAKEAAAKEAAAKEAAAK | 12,191 | PERV_Q4VFZ2_3mutA_WS |
| GGSEAAAKPAP | 12,192 | MLVCB_P08361_3mutA |
| PAPAPAPAPAPAP | 12,193 | MLVBM_Q7SVK7_3mutA_WS |
| GGSPAPGGG | 12,194 | MLVMS_P03355_3mutA_WS |
| GGSEAAAKGGG | 12,195 | MLVMS_P03355_3mut |
| GGSGGSGGSGGS | 12,196 | MLVFF_P26809_3mutA |
| EAAAKEAAAKEAAAKEAAAKEAAAKEAAAK | 12,197 | MLVFF_P26809_3mutA |
| GGG | | AVIRE_P03360_3mutA |
| AEAAAKEAAAKEAAAKEAAAKALEAEAAAKEAAAKEAAAKEAAAKA | 12,199 | PERV_Q4VFZ2_3mut |
| GGSGGSGGSGGS | 12,200 | MLVMS_P03355_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGEAAAK | 12,201 | MLVCB_P08361_3mutA |
| GSSGSSGSSGSSGSSGSS | 12,202 | MLVMS_P03355_3mutA_WS |
| GSSGGGPAP | 12,203 | MLVMS_P03355_3mutA_WS |
| GSSEAAAKPAP | 12,204 | MLVFF_P26809_3mutA |
| EAAAKEAAAK | 12,205 | MLVMS_P03355_PLV919 |
| GGGGSGGGGSGGGGSGGGGSGGGGGS | 12,206 | MLVCB_P08361_3mut |
| GGGGGG | 12,207 | MLVMS_P03355_3mutA_WS |
| GGSGSSGGG | 12,208 | MLVFF_P26809_3mutA |
| GSSGGGEAAAK | 12,209 | PERV_Q4VFZ2_3mutA_WS |
| PAPAPAPAPAP | 12,210 | PERV_Q4VFZ2_3mut |
| EAAAKEAAAKEAAAKEAAAKEAAAKEAAAK | 12,211 | SFV3L_P27401_2mut |
| EAAAKGGSGGG | 12,212 | BAEVM_P10272_3mutA |
| GGGGSSPAP | 12,213 | PERV_Q4VFZ2_3mutA_WS |
| GGGEAAAKPAP | 12,214 | MLVMS_P03355_PLV919 |
| GGSGGGPAP | 12,215 | BAEVM_P10272_3mutA |
| PAPGSSGGS | 12,216 | MLVMS_P03355_PLV919 |
| GGSGGGPAP | 12,217 | MLVMS_P03355_3mutA_WS |
| EAAAKGGSPAP | 12,218 | PERV_Q4VFZ2_3mutA_WS |
| EAAAKGGSGGG | 12,219 | MLVMS_P03355_3mutA_WS |
| PAPGSSGGG | 12,220 | MLVFF_P26809_3mutA |
| GSSEAAAKGGS | 12,221 | MLVFF_P26809_3mutA |
| PAPGSSEAAAK | 12,222 | MLVFF_P26809_3mutA |
| EAAAKGSSPAP | 12,223 | KORV_Q9TTC1-Pro_3mutA |
| EAAAKEAAAKEAAAKEAAAKEAAAK | 12,224 | MLVBM_Q7SVK7_3mutA_WS |
| PAPGSSEAAAK | 12,225 | MLVMS_P03355_PLV919 |
| EAAAKGSSGGG | 12,226 | MLVMS_P03355_3mutA_WS |
| EAAAKGGGGGS | 12,227 | AVIRE_P03360_3mutA |
| EAAAKEAAAKEAAAK | 12,228 | MLVMS_P03355_PLV919 |
| PAPAPAPAPAPAP | 12,229 | MLVFF_P26809_3mutA |
| GGGGSGGGGSGGGGS | 12,230 | MLVCB_P08361_3mutA |
| PAPGGSEAAAK | 12,231 | MLVCB_P08361_3mutA |
| PAPGSSEAAAK | 12,232 | MLVBM_Q7SVK7_3mutA_WS |
| PAPEAAAKGSS | 12,233 | AVIRE_P03360_3mutA |
| GGSPAPGSS | 12,234 | WMSV_P03359_3mutA |
| PAPGGSGGG | 12,235 | MLVMS_P03355_PLV919 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKGGSGSS | 12,236 | MLVMS_P03355_3mutA_WS |
| GGSGGG | 12,237 | MLVFF_P26809_3mutA |
| GGSEAAAKGSS | 12,238 | KORV_Q9TTC1_3mutA |
| AEAAAKEAAAKEAAAKEAAAKALEAEAAAKEAAAKEAAAKEAAAKA | 12,239 | MLVCB_P08361_3mutA |
| PAPAPAPAPAPAP | 12,240 | PERV_Q4VFZ2_3mutA_WS |
| PAPEAAAK | 12,241 | MLVMS_P03355_3mutA_WS |
| GGSEAAAKGGG | 12,242 | MLVMS_P03355_PLV919 |
| GSSPAP | 12,243 | MLVMS_P03355_3mutA_WS |
| GGGGSS | 12,244 | MLVMS_P03355_PLV919 |
| GGGEAAAKPAP | 12,245 | AVIRE_P03360_3mutA |
| EAAAKPAPGGS | 12,246 | MLVAV_P03356_3mutA |
| EAAAKGGGPAP | 12,247 | MLVAV_P03356_3mutA |
| PAPGGSEAAAK | 12,248 | BAEVM_P10272_3mutA |
| PAPGGSGSS | 12,249 | MLVMS_P03355_3mutA_WS |
| PAPGGSGSS | 12,250 | AVIRE_P03360_3mutA |
| GGSGGGPAP | 12,251 | MLVMS_P03355_3mutA_WS |
| EAAAKEAAAKEAAAKEAAAK | 12,252 | BAEVM_P10272_3mutA |
| GGGGSGGGGSGGGGSGGGGSGGGGS | 12,253 | MLVMS_P03355_PLV919 |
| GGGGSSPAP | 12,254 | MLVCB_P08361_3mutA |
| GSSGGGPAP | 12,255 | MLVFF_P26809_3mutA |
| GGGGSSGGS | 12,256 | MLVMS_P03355_PLV919 |
| GGSGGG | 12,257 | MLVCB_P08361_3mutA |
| GSSGGGGGS | 12,258 | MLVMS_P03355_PLV919 |
| SGGSSGGSSGSETPGTSESATPESSGGSSGGSS | 12,259 | XMRV6_A1Z651_3mutA |
| GGGGGSGSS | 12,260 | KORV_Q9TTC1_3mut |
| GGGEAAAKGGS | 12,261 | BAEVM_P10272_3mutA |
| GGSGGG | 12,262 | BAEVM_P10272_3mutA |
| PAPAPAP | 12,263 | KORV_Q9TTC1-Pro_3mut |
| AEAAAKEAAAKEAAAKEAAAKALEAEAAAKEAAAKEAAAKEAAAKA | 12,264 | SFV3L_P27401_2mutA |
| AEAAAKEAAAKEAAAKEAAAKALEAEAAAKEAAAKEAAAKEAAAKA | 12,265 | MLVBM_Q7SVK7_3mutA_WS |
| GSSGSSGSSGSSGSS | 12,266 | MLVMS_P03355_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSGGGEAAAK | 12,267 | MLVMS_P03355_3mutA_WS |
| GSSGGSEAAAK | 12,268 | MLVFF_P26809_3mutA |
| PAP | | MLVMS_P03355_PLV919 |
| EAAAKGGGGSEAAAK | 12,270 | MLVBM_Q7SVK7_3mutA_WS |
| PAPAP | 12,271 | AVIRE_P03360_3mutA |
| PAP | | MLVFF_P26809_3mutA |
| GSSGGG | 12,273 | MLVMS_P03355_3mut |
| GSSPAPGGS | 12,274 | MLVFF_P26809_3mutA |
| PAPAPAPAP | 12,275 | XMRV6_A1Z651_3mutA |
| EAAAKGSSGGS | 12,276 | PERV_Q4VFZ2_3mut |
| PAPEAAAKGGG | 12,277 | KORV_Q9TTC1-Pro_3mutA |
| PAPGGS | 12,278 | MLVCB_P08361_3mutA |
| EAAAKGGG | 12,279 | MLVCB_P08361_3mutA |
| GSSEAAAKPAP | 12,280 | MLVMS_P03355_PLV919 |
| PAPGGS | 12,281 | MLVFF_P26809_3mutA |
| EAAAKGGS | 12,282 | MLVCB_P08361_3mutA |
| EAAAKEAAAKEAAAKEAAAKEAAAKEAAAK | 12,283 | FLV_P10273_3mutA |
| PAPGGSEAAAK | 12,284 | MLVAV_P03356_3mutA |
| GSS | | MLVCB_P08361_3mutA |
| GSSGSSGSSGSS | 12,286 | AVIRE_P03360_3mutA |
| GSSGSSGSS | 12,287 | MLVFF_P26809_3mutA |
| GSSGGG | 12,288 | MLVMS_P03355_PLV919 |
| EAAAK | 12,289 | MLVFF_P26809_3mutA |
| GGSPAPEAAAK | 12,290 | MLVCB_P08361_3mutA |
| GGSGSS | 12,291 | MLVCB_P08361_3mutA |
| GSSPAPGGG | 12,292 | MLVMS_P03355_PLV919 |
| EAAAKEAAAKEAAAKEAAAKEAAAK | 12,293 | MLVAV_P03356_3mutA |
| EAAAKGSSPAP | 12,294 | FLV_P10273_3mutA |
| GGGGSS | 12,295 | XMRV6_A1Z651_3mutA |
| GGSPAPGSS | 12,296 | MLVMS_P03355_PLV919 |
| EAAAKEAAAKEAAAKEAAAKEAAAK | 12,297 | MLVMS_P03355_3mutA_WS |
| PAPEAAAKGGG | 12,298 | FLV_P10273_3mutA |
| EAAAKPAPGGS | 12,299 | XMRV6_A1Z651_3mut |
| PAPAP | 12,300 | BAEVM_P10272_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKEAAAKEAAAKEAAAK | 12,301 | MLVMS_P03355_PLV919 |
| GSSPAPGGG | 12,302 | MLVMS_P03355_PLV919 |
| EAAAKGGGPAP | 12,303 | KORV_Q9TTC1_3mutA |
| PAPEAAAK | 12,304 | MLVMS_P03355_PLV919 |
| PAPGGGEAAAK | 12,305 | PERV_Q4VFZ2_3mutA_WS |
| EAAAKGSSGGS | 12,306 | MLVMS_P03355_3mutA_WS |
| EAAAKEAAAKEAAAK | 12,307 | MLVMS_P03355_PLV919 |
| GSSEAAAK | 12,308 | MLVMS_P03355_3mutA_WS |
| GSSGSSGSSGSS | 12,309 | MLVMS_P03355_3mutA_WS |
| GGGGSGGGGSGGGGSGGGGS | 12,310 | MLVMS_P03355_3mutA_WS |
| EAAAKGGGGSEAAAK | 12,311 | MLVMS_P03355_3mut |
| GGS | | MLVCB_P08361_3mutA |
| GGGGSGGGGSGGGGSGGGGSGGGGGSGGGGS | 12,313 | XMRV6_A1Z651_3mutA |
| GGSGSSPAP | 12,314 | MLVCB_P08361_3mutA |
| GGGGSGGGGSGGGGS | 12,315 | XMRV6_A1Z651_3mutA |
| PAPAPAPAPAP | 12,316 | BAEVM_P10272_3mutA |
| PAPAPAPAPAP | 12,317 | MLVMS_P03355_3mutA_WS |
| EAAAKEAAAKEAAAKEAAAK | 12,318 | MLVBM_Q7SVK7_3mut |
| GGGGSGGGGSGGGGSGGGGSGGGGS | 12,319 | BAEVM_P10272_3mutA |
| GGSGGSGGS | 12,320 | MLVMS_P03355_3mutA_WS |
| EAAAKPAPGSS | 12,321 | MLVMS_P03355_PLV919 |
| GSS | | MLVMS_P03355_3mutA_WS |
| PAPEAAAKGGS | 12,323 | MLVMS_P03355_3mutA_WS |
| GGGPAPGGS | 12,324 | MLVMS_P03355_3mutA_WS |
| EAAAKGGGGSS | 12,325 | MLVAV_P03356_3mutA |
| GSSGSSGSSGSSGSS | 12,326 | MLVFF_P26809_3mut |
| SGSETPGTSESATPES | 12,327 | PERV_Q4VFZ2_3mut |
| GGSEAAAKGGG | 12,328 | MLVMS_P03355_3mut |
| GSSGSSGSSGSSGSSGSS | 12,329 | AVIRE_P03360_3mutA |
| PAPAPAPAPAPAP | 12,330 | AVIRE_P03360_3mut |
| GGSGGS | 12,331 | XMRV6_A1Z651_3mutA |
| PAPGSSEAAAK | 12,332 | MLVCB_P08361_3mut |
| GGSPAPEAAAK | 12,333 | PERV_Q4VFZ2_3mut |
| EAAAKGGGGGS | 12,334 | MLVCB_P08361_3mutA |
| GGSGGSGGSGGS | 12,335 | MLVMS_P03355_PLV919 |
| GGGGSSEAAAK | 12,336 | MLVMS_P03355_PLV919 |
| GSSEAAAKGGG | 12,337 | MLVFF_P26809_3mutA |
| PAPGGS | 12,338 | MLVMS_P03355_3mutA_WS |
| EAAAKGGSGGG | 12,339 | MLVCB_P08361_3mutA |
| EAAAKGGG | 12,340 | PERV_Q4VFZ2_3mut |
| PAPGGS | 12,341 | XMRV6_A1Z651_3mutA |
| GSSPAPGGG | 12,342 | XMRV6_A1Z651_3mutA |
| PAPEAAAKGGG | 12,343 | MLVMS_P03355_3mutA_WS |
| GSSEAAAKGGG | 12,344 | PERV_Q4VFZ2_3mutA_WS |
| PAPGGSEAAAK | 12,345 | XMRV6_A1Z651_3mutA |
| GGGGGS | 12,346 | MLVMS_P03355_3mutA_WS |
| GGSPAPEAAAK | 12,347 | MLVMS_P03355_3mutA_WS |
| GGGPAP | 12,348 | MLVFF_P26809_3mutA |
| PAPGSSGGG | 12,349 | XMRV6_A1Z651_3mutA |
| PAPGSSGGG | 12,350 | MLVBM_Q7SVK7_3mutA_WS |
| GGGEAAAKGSS | 12,351 | MLVMS_P03355_3mutA_WS |
| GSSEAAAKGGS | 12,352 | MLVCB_P08361_3mutA |
| PAPGGSGSS | 12,353 | MLVCB_P08361_3mutA |
| EAAAKGGGGSEAAAK | 12,354 | BAEVM_P10272_3mutA |
| PAPAPAP | 12,355 | PERV_Q4VFZ2_3mutA_WS |
| GGGGGG | 12,356 | MLVAV_P03356_3mutA |
| GSSPAPEAAAK | 12,357 | MLVCB_P08361_3mutA |
| GGSGGSGGS | 12,358 | MLVMS_P03355_3mutA_WS |
| GSSGSSGSSGSSGSS | 12,359 | XMRV6_A1Z651_3mut |
| GGGPAPGGS | 12,360 | XMRV6_A1Z651_3mutA |
| GGGPAPEAAAK | 12,361 | BAEVM_P10272_3mutA |
| GGSGGG | 12,362 | AVIRE_P03360_3mutA |
| SGSETPGTSESATPES | 12,363 | PERV_Q4VFZ2_3mutA_WS |
| EAAAKGSSPAP | 12,364 | MLVMS_P03355_PLV919 |
| GSSEAAAK | 12,365 | XMRV6_A1Z651_3mut |
| GSSGGSGGG | 12,366 | MLVFF_P26809_3mutA |
| EAAAKEAAAKEAAAKEAAAKEAAAK | 12,367 | WMSV_P03359_3mutA |
| GGGGSEAAAKGGGGS | 12,368 | MLVMS_P03355_PLV919 |
| PAPGGGGSS | 12,369 | MLVMS_P03355_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| SGSETPGTSESATPES | 12,370 | MLVMS_P03355_3mutA_WS |
| GGSPAPEAAAK | 12,371 | KORV_Q9TTC1-Pro_3mutA |
| GSSEAAAKGGG | 12,372 | MLVMS_P03355_3mutA_WS |
| GSSEAAAK | 12,373 | WMSV_P03359_3mutA |
| GGGGSEAAAKGGGGS | 12,374 | AVIRE_P03360_3mutA |
| GSS | | WMSV_P03359_3mutA |
| PAPGGSEAAAK | 12,376 | MLVFF_P26809_3mutA |
| GGGGS | 12,377 | MLVMS_P03355_3mutA_WS |
| GGGPAP | 12,378 | MLVMS_P03355_3mutA_WS |
| EAAAKEAAAKEAAAKEAAAKEAAAKEAAAK | 12,379 | MLVMS_P03355_3mutA_WS |
| EAAAKPAPGSS | 12,380 | PERV_Q4VFZ2_3mut |
| EAAAKPAPGSS | 12,381 | MLVCB_P08361_3mutA |
| GGGGGG | 12,382 | WMSV_P03359_3mutA |
| EAAAKPAPGGS | 12,383 | MLVMS_P03355_PLV919 |
| PAPGGGEAAAK | 12,384 | PERV_Q4VFZ2_3mut |
| EAAAKEAAAKEAAAKEAAAKEAAAK | 12,385 | AVIRE_P03360_3mutA |
| GSSEAAAKPAP | 12,386 | XMRV6_A1Z651_3mutA |
| PAPGGSEAAAK | 12,387 | MLVBM_Q7SVK7_3mutA_WS |
| PAPGSS | 12,388 | MLVCB_P08361_3mutA |
| EAAAKGGG | 12,389 | MLVMS_P03355_3mutA_WS |
| EAAAKPAP | 12,390 | MLVCB_P08361_3mutA |
| PAPEAAAKGGS | 12,391 | MLVBM_Q7SVK7_3mutA_WS |
| GGSPAPGGG | 12,392 | MLVCB_P08361_3mutA |
| PAPGGSGSS | 12,393 | WMSV_P03359_3mutA |
| EAAAKEAAAKEAAAKEAAAKEAAAKEAAAK | 12,394 | MLVMS_P03355_PLV919 |
| GGSGGGPAP | 12,395 | MLVMS_P03355_PLV919 |
| AEAAAKEAAAKEAAAKEAAAKALEAEAAAKEAAAKEAAAKEAAAKA | 12,396 | MLVMS_P03355 |
| PAPEAAAKGSS | 12,397 | MLVCB_P08361_3mutA |
| EAAAKGSS | 12,398 | MLVMS_P03355_3mutA_WS |
| GGSGGS | 12,399 | MLVMS_P03355_3mutA_WS |
| EAAAKEAAAKEAAAKEAAAKEAAAK | 12,400 | BAEVM_P10272_3mutA |
| GGGGSEAAAKGGGGS | 12,401 | FLV_P10273_3mutA |
| GGSEAAAKGGG | 12,402 | MLVCB_P08361_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSGSSGSSGSSGSS | 12,403 | BAEVM_P10272_3mutA |
| GGGGSGGGGSGGGGSGGGGSGGGGSGGGGS | 12,404 | MLVFF_P26809_3mutA |
| EAAAKGGG | 12,405 | PERV_Q4VFZ2_3mut |
| GGGGGSEAAAK | 12,406 | MLVCB_P08361_3mutA |
| EAAAKPAPGGS | 12,407 | MLVMS_P03355_3mutA_WS |
| GGGGGSGSS | 12,408 | XMRV6_A1Z651_3mutA |
| PAPGSSEAAAK | 12,409 | MLVMS_P03355_3mutA_WS |
| GSSEAAAKPAP | 12,410 | MLVCB_P08361_3mutA |
| EAAAKGSSPAP | 12,411 | MLVAV_P03356_3mutA |
| GGGPAPGGS | 12,412 | WMSV_P03359_3mutA |
| GGSPAP | 12,413 | MLVMS_P03355_3mutA_WS |
| GGSEAAAKGGG | 12,414 | MLVMS_P03355_3mutA_WS |
| GGGGGGGG | 12,415 | MLVFF_P26809_3mutA |
| GGGGGGGGSGGGGSGGGGSGGGGSGGGGS | 12,416 | MLVMS_P03355_3mutA_WS |
| GGGGSGGGGSGGGGSGGGGSGGGGSGGGGS | 12,417 | MLVBM_Q7SVK7_3mutA_WS |
| GSSPAPGGG | 12,418 | MLVAV_P03356_3mutA |
| GGGGGG | 12,419 | AVIRE_P03360_3mutA |
| GSSGGS | 12,420 | MLVMS_P03355_3mutA_WS |
| GGSPAPGSS | 12,421 | MLVFF_P26809_3mutA |
| PAPEAAAKGGG | 12,422 | PERV_Q4VFZ2_3mut |
| EAAAKGGGPAP | 12,423 | MLVFF_P26809_3mutA |
| GGGEAAAKGGS | 12,424 | MLVMS_P03355_PLV919 |
| GGSGSSPAP | 12,425 | MLVFF_P26809_3mutA |
| SGSETPGTSESATPES | 12,426 | WMSV_P03359_3mutA |
| PAPGGSEAAAK | 12,427 | MLVBM_Q7SVK7_3mutA_WS |
| GGSGGG | 12,428 | MLVMS_P03355_PLV919 |
| GGGGSSPAP | 12,429 | PERV_Q4VFZ2_3mut |
| GGGEAAAKGSS | 12,430 | MLVAV_P03356_3mutA |
| PAPAPAPAPAPAP | 12,431 | MLVMS_P03355_3mutA_WS |
| EAAAKGGGGSEAAAK | 12,432 | PERV_Q4VFZ2 |
| EAAAKEAAAKEAAAKEAAAKEAAAK | 12,433 | MLVMS_P03355_PLV919 |
| GGGGGSEAAAK | 12,434 | PERV_Q4VFZ2_3mut |
| PAPGSSEAAAK | 12,435 | MLVCB_P08361_3mutA |
| GSAGSAAGSGEF | 12,436 | PERV_Q4VFZ2_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKGGGGSEAAAK | 12,437 | MLVFF_P26809_3mutA |
| GGSPAPGGG | 12,438 | PERV_Q4VFZ2_3mutA_WS |
| GSSEAAAKGGG | 12,439 | AVIRE_P03360_3mutA |
| GGGEAAAKPAP | 12,440 | MLVMS_P03355_3mutA_WS |
| GGGPAP | 12,441 | AVIRE_P03360_3mutA |
| GGSEAAAK | 12,442 | MLVCB_P08361_3mutA |
| SGGSSGGSSGSETPGTSESATPESSGGSSGGSS | 12,443 | PERV_Q4VFZ2_3mut |
| EAAAKPAPGGS | 12,444 | MLVBM_Q7SVK7_3mutA_WS |
| AEAAAKEAAAKEAAAKEAAAKALEAEAAAKEAAAKEAAAKEAAAKA | 12,445 | XMRV6_A1Z651_3mut |
| GGGGGGGG | 12,446 | MLVCB_P08361_3mutA |
| PAPGSS | 12,447 | PERV_Q4VFZ2_3mut |
| EAAAK | 12,448 | PERV_Q4VFZ2_3mut |
| GSAGSAAGSGEF | 12,449 | MLVMS_P03355_3mutA_WS |
| PAPGGGEAAAK | 12,450 | PERV_Q4VFZ2_3mut |
| EAAAKGSSGGS | 12,451 | MLVFF_P26809_3mut |
| GGGGSEAAAKGGGGS | 12,452 | BAEVM_P10272_3mutA |
| GGGGSGGGGSGGGGS | 12,453 | MLVMS_P03355_PLV919 |
| EAAAKGGGGSEAAAK | 12,454 | BAEVM_P10272_3mut |
| PAPGGGEAAAK | 12,455 | MLVMS_P03355_3mutA_WS |
| GGSEAAAKPAP | 12,456 | MLVMS_P03355_3mutA_WS |
| PAPAP | 12,457 | MLVCB_P08361_3mutA |
| PAPAP | 12,458 | MLVFF_P26809_3mutA |
| GGSPAP | 12,459 | AVIRE_P03360_3mutA |
| EAAAKGSSGGS | 12,460 | MLVCB_P08361_3mutA |
| PAPGSSGGS | 12,461 | AVIRE_P03360_3mutA |
| EAAAKGGGGSEAAAK | 12,462 | XMRV6_A1Z651_3mutA |
| PAPAPAP | 12,463 | BAEVM_P10272_3mutA |
| GGSGGSGGSGGSGGSGGS | 12,464 | MLVMS_P03355_PLV919 |
| GGGGGSGSS | 12,465 | MLVMS_P03355_PLV919 |
| PAPGSSEAAAK | 12,466 | XMRV6_A1Z651_3mut |
| GGSEAAAKPAP | 12,467 | XMRV6_A1Z651_3mutA |
| EAAAKEAAAKEAAAKEAAAK | 12,468 | XMRV6_A1Z651_3mut |
| AEAAAKEAAAKEAAAKEAAAKALEAEAAAKEAAAKEAAAKEAAAKA | 12,469 | WMSV_P03359_3mut |
| GGSGGGEAAAK | 12,470 | XMRV6_A1Z651_3mutA |
| GGGEAAAK | 12,471 | XMRV6_A1Z651_3mutA |
| GGGGSGGGGSGGGGS | 12,472 | MLVMS_P03355_3mutA_WS |
| GGSGGSGGSGGSGGS | 12,473 | MLVFF_P26809_3mutA |
| GSSGGGGGS | 12,474 | MLVMS_P03355_3mut |
| PAPGGSEAAAK | 12,475 | MLVMS_P03355_3mutA_WS |
| GSSGGSPAP | 12,476 | MLVMS_P03355_3mutA_WS |
| SGSETPGTSESATPES | 12,477 | XMRV6_A1Z651_3mutA |
| GGGGGGGGS | 12,478 | MLVMS_P03355_PLV919 |
| PAPAPAPAPAP | 12,479 | MLVMS_P03355_3mut |
| GSSGSS | 12,480 | XMRV6_A1Z651_3mutA |
| GSSEAAAKPAP | 12,481 | PERV_Q4VFZ2_3mut |
| GGSGSSGGG | 12,482 | MLVMS_P03355_3mutA_WS |
| EAAAKEAAAK | 12,483 | MLVCB_P08361_3mutA |
| GSSGSSGSSGSS | 12,484 | MLVMS_P03355_3mutA_WS |
| GSSPAPGGG | 12,485 | PERV_Q4VFZ2_3mutA_WS |
| EAAAKEAAAKEAAAK | 12,486 | MLVMS_P03355_3mutA_WS |
| AEAAAKEAAAKEAAAKEAAAKALEAEAAAKEAAAKEAAAKEAAAKA | 12,487 | SFV1_P23074_2mutA |
| GGGGSGGGGSGGGGSGGGGSGGGGSGGGGS | 12,488 | MLVMS_P03355_PLV919 |
| GSAGSAAGSGEF | 12,489 | MLVMS_P03355_PLV919 |
| PAPGSSEAAAK | 12,490 | MLVMS_P03355_3mutA_WS |
| GGSEAAAK | 12,491 | MLVMS_P03355_3mutA_WS |
| GSSGSSGSSGSSGSS | 12,492 | PERV_Q4VFZ2_3mutA_WS |
| GGSEAAAKPAP | 12,493 | PERV_Q4VFZ2_3mutA_WS |
| GGSGGSGGS | 12,494 | MLVCB_P08361_3mutA |
| EAAAKGGSGSS | 12,495 | MLVCB_P08361_3mutA |
| GGGGSGGGGSGGGGSGGGGSGGGGS | 12,496 | FLV_P10273_3mutA |
| EAAAKEAAAKEAAAKEAAAK | 12,497 | MLVBM_Q7SVK7_3mutA_WS |
| GGSGSSPAP | 12,498 | BAEVM_P10272_3mutA |
| EAAAKEAAAKEAAAKEAAAKEAAAK | 12,499 | XMRV6_A1Z651_3mutA |
| GGGGSGGGGSGGGGSGGGGSGGGGS | 12,500 | MLVBM_Q7SVK7_3mutA_WS |
| GGSGSS | 12,501 | WMSV_P03359_3mutA |
| PAPEAAAK | 12,502 | MLVCB_P08361_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKPAP | 12,503 | BAEVM_P10272_3mutA |
| GSSPAP | 12,504 | PERV_Q4VFZ2_3mutA_WS |
| GGGPAP | 12,505 | PERV_Q4VFZ2_3mutA_WS |
| EAAAKGGSGSS | 12,506 | MLVMS_P03355_3mutA_WS |
| EAAAKGGGGSEAAAK | 12,507 | AVIRE_P03360_3mutA |
| GGSGGG | 12,508 | KORV_Q9TTC1-Pro_3mutA |
| GSSPAP | 12,509 | MLVFF_P26809_3mutA |
| GGSGSSEAAAK | 12,510 | BAEVM_P10272_3mutA |
| PAPGSSGGS | 12,511 | BAEVM_P10272_3mutA |
| GGGGGG | 12,512 | MLVFF_P26809_3mutA |
| PAPGGSEAAAK | 12,513 | MLVMS_P03355_PLV919 |
| PAPGGS | 12,514 | MLVMS_P03355_PLV919 |
| GGSGGSGGSGGS | 12,515 | BAEVM_P10272_3mutA |
| GSSPAP | 12,516 | MLVCB_P08361_3mutA |
| PAPAPAPAP | 12,517 | MLVMS_P03355_3mutA_WS |
| GGGGGG | 12,518 | MLVCB_P08361_3mutA |
| GSSGSSGSSGSSGSSGSS | 12,519 | KORV_Q9TTC1-Pro_3mutA |
| GSSEAAAKGGS | 12,520 | BAEVM_P10272_3mutA |
| GGSEAAAK | 12,521 | FLV_P10273_3mutA |
| GGSGGSGGSGGSGGS | 12,522 | KORV_Q9TTC1-Pro_3mutA |
| GSSPAPEAAAK | 12,523 | PERV_Q4VFZ2_3mut |
| GSSGSSGSSGSSGSS | 12,524 | XMRV6_A1Z651_3mutA |
| EAAAKPAPGGS | 12,525 | MLVMS_P03355_3mut |
| SGGSSGGSSGSETPGTSESATPESSGGSSGGSS | 12,526 | FLV_P10273_3mut |
| GGSPAPEAAAK | 12,527 | XMRV6_A1Z651_3mut |
| EAAAKGGSGGG | 12,528 | MLVFF_P26809_3mutA |
| EAAAKEAAAKEAAAKEAAAK | 12,529 | MLVFF_P26809_3mutA |
| GSSPAP | 12,530 | WMSV_P03359_3mutA |
| PAPAPAPAP | 12,531 | MLVAV_P03356_3mutA |
| PAPGGSEAAAK | 12,532 | KORV_Q9TTC1_3mut |
| GGSGSSEAAAK | 12,533 | MLVBM_Q7SVK7_3mutA_WS |
| GSSGGG | 12,534 | MLVCB_P08361_3mutA |
| GGGEAAAKGSS | 12,535 | PERV_Q4VFZ2_3mut |
| PAPGGSGGG | 12,536 | MLVFF_P26809_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| AEAAAKEAAAKEAAAKEAAAKALEAEAAAKEAAAKEAAAKEAAAKA | 12,537 | FFV_O93209 |
| PAPGGGGSS | 12,538 | MLVMS_P03355_3mutA_WS |
| EAAAKGGS | 12,539 | MLVAV_P03356_3mutA |
| EAAAKEAAAKEAAAKEAAAKEAAAKEAAAK | 12,540 | MLVBM_Q7SVK7_3mutA_WS |
| GGSGGSGGS | 12,541 | WMSV_P03359_3mutA |
| PAPAP | 12,542 | MLVMS_P03355_3mutA_WS |
| GSSGGGEAAAK | 12,543 | MLVAV_P03356_3mutA |
| GGGGSSEAAAK | 12,544 | MLVFF_P26809_3mutA |
| EAAAKGSSGGS | 12,545 | MLVMS_P03355_PLV919 |
| EAAAKGGGGSEAAAK | 12,546 | MLVMS_P03355_3mutA_WS |
| GGGGGGGG | 12,547 | MLVMS_P03355_PLV919 |
| GSSGSSGSS | 12,548 | MLVMS_P03355_PLV919 |
| GGGEAAAKPAP | 12,549 | PERV_Q4VFZ2_3mutA_WS |
| GGGGGSGSS | 12,550 | MLVMS_P03355_3mutA_WS |
| GGGGGGG | 12,551 | MLVMS_P03355_PLV919 |
| GGS | | MLVMS_P03355_PLV919 |
| GSSGGG | 12,553 | MLVMS_P03355_3mutA_WS |
| EAAAKGGSGSS | 12,554 | PERV_Q4VFZ2_3mutA_WS |
| PAPGSSEAAAK | 12,555 | MLVMS_P03355_PLV919 |
| GSSEAAAKPAP | 12,556 | MLVMS_P03355_PLV919 |
| GGSPAPGSS | 12,557 | BAEVM_P10272_3mutA |
| GSAGSAAGSGEF | 12,558 | MLVCB_P08361_3mut |
| GGSPAPGGG | 12,559 | PERV_Q4VFZ2_3mut |
| GGGGSGGGGSGGGGSGGGGS | 12,560 | MLVMS_P03355_3mut |
| GSSGSSGSS | 12,561 | PERV_Q4VFZ2_3mutA_WS |
| EAAAKEAAAKEAAAKEAAAKEAAAKEAAAK | 12,562 | PERV_Q4VFZ2_3mut |
| GGGGSEAAAKGGGGS | 12,563 | MLVCB_P08361_3mutA |
| GGSEAAAKGSS | 12,564 | MLVAV_P03356_3mutA |
| EAAAKGGGGSEAAAK | 12,565 | MLVCB_P08361_3mut |
| EAAAKEAAAKEAAAKEAAAKEAAAKEAAAK | 12,566 | XMRV6_A1Z651_3mutA |
| PAPGGGEAAAK | 12,567 | MLVMS_P03355_3mutA_WS |
| GSSGGGEAAAK | 12,568 | PERV_Q4VFZ2_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSGSS | 12,569 | MLVCB_P08361_3mut |
| PAPAPAPAPAPAP | 12,570 | PERV_Q4VFZ2_3mut |
| GGSPAPGGG | 12,571 | MLVFF_P26809_3mutA |
| GGSGGSGGSGGSGGS | 12,572 | MLVCB_P08361_3mutA |
| EAAAKEAAAK | 12,573 | MLVFF_P26809_3mutA |
| AEAAAKEAAAKEAAAKEAAAKALEAEAAAKEAAAKEAAAKEAAAKA | 12,574 | GALV_P21414_3mut |
| PAPAPAPAPAPAP | 12,575 | WMSV_P03359_3mutA |
| GGGEAAAKGGS | 12,576 | KORV_Q9TTC1_3mutA |
| EAAAKGGGPAP | 12,577 | KORV_Q9TTC1_3mut |
| PAPEAAAKGSS | 12,578 | MLVBM_Q7SVK7_3mutA_WS |
| PAPEAAAKGSS | 12,579 | FLV_P10273_3mutA |
| PAPGGSEAAAK | 12,580 | MLVMS_P03355_3mut |
| GSSPAPGGG | 12,581 | BAEVM_P10272_3mutA |
| GGGEAAAKPAP | 12,582 | KORV_Q9TTC1-Pro_3mutA |
| GGGGSGGGGS | 12,583 | MLVMS_P03355_PLV919 |
| GGGEAAAKGSS | 12,584 | MLVFF_P26809_3mutA |
| PAPGGGGSS | 12,585 | MLVBM_Q7SVK7_3mutA_WS |
| GSSEAAAK | 12,586 | BAEVM_P10272_3mutA |
| GGGGGGGG | 12,587 | MLVMS_P03355_PLV919 |
| PAPGSSGGS | 12,588 | MLVAV_P03356_3mutA |
| GGGGSGGGGSGGGGSGGGGS | 12,589 | BAEVM_P10272_3mutA |
| PAP | | MLVMS_P03355_3mut |
| EAAAKGSSPAP | 12,591 | XMRV6_A1Z651_3mutA |
| PAPEAAAKGGS | 12,592 | MLVFF_P26809_3mutA |
| GSSGGGEAAAK | 12,593 | BAEVM_P10272_3mutA |
| PAPAPAP | 12,594 | MLVMS_P03355_3mutA_WS |
| GGSEAAAKGGG | 12,595 | MLVMS_P03355_PLV919 |
| GSSEAAAK | 12,596 | PERV_Q4VFZ2_3mut |
| GGGG | 12,597 | MLVMS_P03355_3mutA_WS |
| GGGGGS | 12,598 | MLVMS_P03355_3mut |
| GGGGSSEAAAK | 12,599 | PERV_Q4VFZ2_3mut |
| EAAAKEAAAKEAAAKEAAAKEAAAKEAAAK | 12,600 | SFV3L_P27401-Pro_2mutA |
| GGSEAAAKGSS | 12,601 | MLVMS_P03355_3mutA_WS |
| PAPGSSGGS | 12,602 | XMRV6_A1Z651_3mutA |
| GGSPAP | 12,603 | MLVMS_P03355_3mutA_WS |
| GGGGSSEAAAK | 12,604 | BAEVM_P10272_3mut |
| GGSGGSGGSGGS | 12,605 | AVIRE_P03360_3mutA |
| PAPGSSGGS | 12,606 | MLVFF_P26809_3mutA |
| GSSPAPGGG | 12,607 | MLVMS_P03355_3mutA_WS |
| GGGGGGG | 12,608 | MLVMS_P03355_3mutA_WS |
| EAAAKGGGGGS | 12,609 | MLVMS_P03355_3mutA_WS |
| EAAAKGGSGGG | 12,610 | MLVMS_P03355_PLV919 |
| GGGGSSEAAAK | 12,611 | XMRV6_A1Z651_3mutA |
| GGGGSEAAAKGGGGS | 12,612 | MLVBM_Q7SVK7_3mutA_WS |
| GSSGSS | 12,613 | MLVMS_P03355_PLV919 |
| GGSGGG | 12,614 | MLVMS_P03355_PLV919 |
| PAPEAAAKGGG | 12,615 | AVIRE_P03360_3mutA |
| AEAAAKEAAAKEAAAKEAAAKALEAEAAAKEAAAKEAAAKEAAAKA | 12,616 | FOAMV_P14350-Pro_2mutA |
| GGGGGSGSS | 12,617 | PERV_Q4VFZ2_3mut |
| GSSGSSGSSGSSGSS | 12,618 | KORV_Q9TTC1-Pro_3mut |
| GGGGSEAAAKGGGGS | 12,619 | MLVMS_P03355_3mutA_WS |
| GGGGGSPAP | 12,620 | FLV_P10273_3mut |
| GGGEAAAK | 12,621 | MLVMS_P03355_3mutA_WS |
| GGSGGSGGSGGS | 12,622 | FLV_P10273_3mutA |
| GGG | | MLVMS_P03355_PLV919 |
| GGSPAPEAAAK | 12,624 | BAEVM_P10272_3mutA |
| EAAAKEAAAK | 12,625 | FLV_P10273_3mutA |
| GGGEAAAKPAP | 12,626 | BAEVM_P10272_3mutA |
| GGGEAAAKGGS | 12,627 | PERV_Q4VFZ2_3mut |
| GGSGGSGGS | 12,628 | PERV_Q4VFZ2_3mut |
| EAAAKGGGPAP | 12,629 | XMRV6_A1Z651_3mutA |
| EAAAK | 12,630 | MLVBM_Q7SVK7_3mutA_WS |
| PAPEAAAKGGG | 12,631 | PERV_Q4VFZ2_3mut |
| EAAAKGSS | 12,632 | MLVCB_P08361_3mutA |
| GGSEAAAKGGG | 12,633 | MLVBM_Q7SVK7_3mutA_WS |
| GGGGSGGGGSGGGGSGGGGS | 12,634 | XMRV6_A1Z651_3mutA |
| GGGGSGGGGGGGGSGGGGSGGGGS | 12,635 | BAEVM_P10272_3mut |
| GGGGSSPAP | 12,636 | PERV_Q4VFZ2_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSGGSGGSGGSGGSGGS | 12,637 | PERV_Q4VFZ2_3mut |
| GGGEAAAKPAP | 12,638 | PERV_Q4VFZ2_3mut |
| EAAAKEAAAK | 12,639 | BAEVM_P10272_3mutA |
| GGSGSSEAAAK | 12,640 | XMRV6_A1Z651_3mutA |
| PAPEAAAKGSS | 12,641 | WMSV_P03359_3mutA |
| PAPAPAPAPAP | 12,642 | XMRV6_A1Z651_3mutA |
| GSSGGGEAAAK | 12,643 | MLVMS_P03355_PLV919 |
| GSSPAPGGG | 12,644 | MLVFF_P26809_3mutA |
| GGSPAPEAAAK | 12,645 | MLVFF_P26809_3mut |
| PAPGGSEAAAK | 12,646 | PERV_Q4VFZ2_3mut |
| GGGGSS | 12,647 | MLVFF_P26809_3mutA |
| GGSGSSGGG | 12,648 | BAEVM_P10272_3mutA |
| GSSGGGEAAAK | 12,649 | MLVMS_P03355_3mutA_WS |
| EAAAKGGS | 12,650 | MLVBM_Q7SVK7_3mutA_WS |
| GGGPAPGGS | 12,651 | MLVMS_P03355_PLV919 |
| EAAAKEAAAK | 12,652 | MLVMS_P03355_PLV919 |
| GSSGSSGSS | 12,653 | MLVMS_P03355_PLV919 |
| GGGEAAAKPAP | 12,654 | MLVAV_P03356_3mutA |
| SGSETPGTSESATPES | 12,655 | FLV_P10273_3mutA |
| PAPAPAPAPAP | 12,656 | KORV_Q9TTC1-Pro_3mut |
| AEAAAKEAAAKEAAAKEAAAKALEAEAAAKEAAAKEAAAKEAAAKA | 12,657 | BAEVM_P10272_3mutA |
| PAPGSSGGG | 12,658 | MLVMS_P03355_3mutA_WS |
| GSSGGGEAAAK | 12,659 | XMRV6_A1Z651_3mutA |
| GGGGSGGGGSGGGGSGGGGSGGGGS | 12,660 | XMRV6_A1Z651_3mutA |
| GGGGSSPAP | 12,661 | MLVFF_P26809_3mutA |
| GGSGGGPAP | 12,662 | PERV_Q4VFZ2_3mutA_WS |
| GSS | | PERV_Q4VFZ2_3mut |
| EAAAKGSSPAP | 12,664 | MLVMS_P03355_3mut |
| EAAAKGGG | 12,665 | XMRV6_A1Z651_3mutA |
| GSSGSSGSSGSS | 12,666 | WMSV_P03359_3mutA |
| PAPEAAAKGSS | 12,667 | MLVMS_P03355_PLV919 |
| GSSEAAAK | 12,668 | AVIRE_P03360_3mutA |
| EAAAKGGSGSS | 12,669 | AVIRE_P03360_3mutA |
| GSSEAAAK | 12,670 | MLVMS_P03355_3mut |
| GGSGSSEAAAK | 12,671 | MLVMS_P03355_PLV919 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSEAAAKGGG | 12,672 | MLVFF_P26809_3mutA |
| GGGGSGGGGSGGGGSGGGGS | 12,673 | MLVAV_P03356_3mutA |
| PAPAPAPAPAPAP | 12,674 | MLVFF_P26809_3mut |
| EAAAKPAPGSS | 12,675 | KORV_Q9TTC1-Pro_3mut |
| PAPGSSEAAAK | 12,676 | MLVAV_P03356_3mutA |
| GGGGSSPAP | 12,677 | WMSV_P03359_3mutA |
| EAAAKGGGGGS | 12,678 | MLVMS_P03355_3mutA_WS |
| GGGEAAAKGGS | 12,679 | MLVMS_P03355_3mut |
| GGSGSSGGG | 12,680 | MLVMS_P03355_3mut |
| GGGPAPGGS | 12,681 | MLVAV_P03356_3mutA |
| PAPGGGGGS | 12,682 | MLVMS_P03355_PLV919 |
| GGGPAPGSS | 12,683 | PERV_Q4VFZ2_3mut |
| GGGGGGG | 12,684 | MLVFF_P26809_3mutA |
| GGSGGGGSS | 12,685 | MLVCB_P08361_3mutA |
| GGGGGG | 12,686 | FLV_P10273_3mutA |
| GGSEAAAKGSS | 12,687 | PERV_Q4VFZ2_3mut |
| GGSPAPGGG | 12,688 | BAEVM_P10272_3mutA |
| GGSPAPGSS | 12,689 | AVIRE_P03360_3mutA |
| GGSGGSGGSGGS | 12,690 | KORV_Q9TTC1_3mut |
| EAAAKEAAAKEAAAKEAAAKEAAAK | 12,691 | MLVBM_Q7SVK7_3mut |
| PAPGSSGGS | 12,692 | XMRV6_A1Z651_3mut |
| EAAAKGGGGSS | 12,693 | PERV_Q4VFZ2_3mutA_WS |
| GGSGGSGGSGGSGGS | 12,694 | PERV_Q4VFZ2_3mutA_WS |
| PAPGGSGGG | 12,695 | MLVMS_P03355_PLV919 |
| PAPGSSGGG | 12,696 | PERV_Q4VFZ2_3mutA_WS |
| GSSGSS | 12,697 | BAEVM_P10272_3mutA |
| EAAAKGSS | 12,698 | MLVFF_P26809_3mutA |
| GGGPAP | 12,699 | MLVMS_P03355_PLV919 |
| EAAAKGGGGGS | 12,700 | MLVFF_P26809_3mutA |
| EAAAKGGSPAP | 12,701 | MLVBM_Q7SVK7_3mutA_WS |
| EAAAKEAAAKEAAAKEAAAKEAAAKEAAAK | 12,702 | WMSV_P03359_3mutA |
| GSSPAPGGG | 12,703 | MLVBM_Q7SVK7_3mutA_WS |
| GGGEAAAKGSS | 12,704 | AVIRE_P03360_3mutA |
| GGGGSSEAAAK | 12,705 | AVIRE_P03360_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGGGGGG | 12,706 | PERV_Q4VFZ2_3mutA_WS |
| PAPGSSEAAAK | 12,707 | BAEVM_P10272_3mutA |
| EAAAKGSS | 12,708 | MLVFF_P26809_3mut |
| GSSEAAAKGGG | 12,709 | MLVCB_P08361_3mutA |
| GGSEAAAK | 12,710 | MLVBM_Q7SVK7_3mutA_WS |
| GSSEAAAKGGG | 12,711 | PERV_Q4VFZ2_3mutA_WS |
| PAPGGSGGG | 12,712 | WMSV_P03359_3mutA |
| GSSGGSGGG | 12,713 | MLVCB_P08361_3mutA |
| EAAAKGSSGGG | 12,714 | FLV_P10273_3mutA |
| GSSEAAAK | 12,715 | MLVCB_P08361_3mutA |
| GSSGGGEAAAK | 12,716 | MLVMS_P03355_3mut |
| GGGGSGGGGS | 12,717 | MLVCB_P08361_3mutA |
| EAAAKGGGGSEAAAK | 12,718 | MLVBM_Q7SVK7_3mutA_WS |
| EAAAKGGG | 12,719 | PERV_Q4VFZ2_3mutA_WS |
| EAAAKGGSPAP | 12,720 | MLVMS_P03355_PLV919 |
| GGGPAPGGS | 12,721 | AVIRE_P03360_3mutA |
| GSSEAAAK | 12,722 | MLVBM_Q7SVK7_3mutA_WS |
| GSSGGGEAAAK | 12,723 | PERV_Q4VFZ2_3mut |
| SGSETPGTSESATPES | 12,724 | MLVMS_P03355_PLV919 |
| GGSGSSPAP | 12,725 | MLVMS_P03355_3mut |
| GGGGGG | 12,726 | MLVBM_Q7SVK7_3mutA_WS |
| GGSPAPGGG | 12,727 | XMRV6_A1Z651_3mutA |
| GGSGSS | 12,728 | PERV_Q4VFZ2_3mutA_WS |
| PAP | | MLVBM_Q7SVK7_3mutA_WS |
| EAAAKPAPGSS | 12,730 | MLVMS_P03355_PLV919 |
| EAAAKGGG | 12,731 | MLVMS_P03355_3mut |
| GSSEAAAKPAP | 12,732 | PERV_Q4VFZ2_3mutA_WS |
| GGGGSS | 12,733 | MLVMS_P03355_3mutA_WS |
| GGSGSSEAAAK | 12,734 | PERV_Q4VFZ2_3mut |
| GGGGSS | 12,735 | BAEVM_P10272_3mutA |
| PAPAP | 12,736 | MLVFF_P26809_3mut |
| PAPEAAAKGGG | 12,737 | BAEVM_P10272_3mutA |
| EAAAKGGS | 12,738 | MLVMS_P03355_PLV919 |
| PAPAPAPAPAPAP | 12,739 | PERV_Q4VFZ2_3mutA_WS |
| GGGGGSEAAAK | 12,740 | MLVMS_P03355_3mut |
| PAPGGS | 12,741 | PERV_Q4VFZ2_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGGSS | 12,742 | MLVCB_P08361_3mutA |
| GGGGS | 12,743 | MLVAV_P03356_3mutA |
| GSSPAPEAAAK | 12,744 | MLVMS_P03355_PLV919 |
| GGGGSSGGS | 12,745 | MLVFF_P26809_3mutA |
| PAPEAAAKGSS | 12,746 | MLVMS_P03355_PLV919 |
| GGSGSSEAAAK | 12,747 | MLVMS_P03355_3mutA_WS |
| EAAAKGGG | 12,748 | MLVAV_P03356_3mutA |
| PAPGSSEAAAK | 12,749 | FLV_P10273_3mutA |
| EAAAKGSSGGG | 12,750 | MLVCB_P08361_3mutA |
| PAPEAAAK | 12,751 | KORV_Q9TTC1-Pro_3mutA |
| GGSPAPEAAAK | 12,752 | KORV_Q9TTC1-Pro_3mut |
| GGSGGSGGSGGSGGSGGS | 12,753 | MLVAV_P03356_3mutA |
| GSSEAAAKPAP | 12,754 | MLVBM_Q7SVK7_3mutA_WS |
| AEAAAKEAAAKEAAAKEAAAKALEAEAAAKEAAAKEAAAKEAAAKA | 12,755 | KORV_Q9TTC1-Pro_3mutA |
| GSSGGGEAAAK | 12,756 | XMRV6_A1Z651_3mut |
| PAPGGSGGG | 12,757 | AVIRE_P03360_3mutA |
| PAPGGSEAAAK | 12,758 | PERV_Q4VFZ2_3mutA_WS |
| GGGGS | 12,759 | MLVMS_P03355_3mutA_WS |
| GGGGSGGGGSGGGGS | 12,760 | MLVBM_Q7SVK7_3mutA_WS |
| PAPAPAPAPAP | 12,761 | PERV_Q4VFZ2_3mutA_WS |
| EAAAKEAAAKEAAAKEAAAKEAAAK | 12,762 | MLVMS_P03355_3mut |
| GSSGGSEAAAK | 12,763 | MLVMS_P03355_3mutA_WS |
| GGSGGSGGSGGS | 12,764 | WMSV_P03359_3mutA |
| EAAAKGSSGGG | 12,765 | WMSV_P03359_3mutA |
| EAAAKGGG | 12,766 | PERV_Q4VFZ2_3mutA_WS |
| SGSETPGTSESATPES | 12,767 | PERV_Q4VFZ2_3mut |
| PAPGSSGGS | 12,768 | MLVMS_P03355_3mutA_WS |
| PAPEAAAKGSS | 12,769 | PERV_Q4VFZ2_3mut |
| PAPEAAAK | 12,770 | AVIRE_P03360_3mutA |
| GSSEAAAKGGG | 12,771 | BAEVM_P10272_3mutA |
| GSSPAP | 12,772 | MLVAV_P03356_3mutA |
| EAAAKEAAAKEAAAKEAAAK | 12,773 | MLVFF_P26809_3mut |
| PAPGGSGSS | 12,774 | MLVAV_P03356_3mutA |
| GGGGSGGGGSGGGGS | 12,775 | PERV_Q4VFZ2_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSGGSEAAAK | 12,776 | MLVCB_P08361_3mutA |
| EAAAKGGS | 12,777 | KORV_Q9TTC1-Pro_3mutA |
| EAAAKGGS | 12,778 | MLVFF_P26809_3mutA |
| GGSPAP | 12,779 | MLVMS_P03355_PLV919 |
| GGSGSS | 12,780 | MLVMS_P03355_PLV919 |
| SGSETPGTSESATPES | 12,781 | WMSV_P03359_3mut |
| GGGGGGG | 12,782 | WMSV_P03359_3mut |
| GGSPAPGSS | 12,783 | MLVCB_P08361_3mutA |
| GGGGSSGGS | 12,784 | WMSV_P03359_3mut |
| PAPGGS | 12,785 | MLVMS_P03355_PLV919 |
| PAPGSSGGS | 12,786 | MLVCB_P08361_3mutA |
| EAAAKEAAAKEAAAKEAAAKEAAAK | 12,787 | MLVFF_P26809_3mut |
| SGGSSGGSSGSETPGTSESATPESSGGSSGGSS | 12,788 | PERV_Q4VFZ2_3mut |
| GGSGGSGGSGGSGGS | 12,789 | BAEVM_P10272_3mutA |
| GSSEAAAK | 12,790 | PERV_Q4VFZ2_3mut |
| EAAAKEAAAKEAAAKEAAAK | 12,791 | KORV_Q9TTC1-Pro_3mutA |
| GGSGGSGGSGGSGGS | 12,792 | MLVMS_P03355_3mut |
| PAPAPAPAPAPAP | 12,793 | MLVMS_P03355_3mut |
| GGSPAPEAAAK | 12,794 | MLVMS_P03355_PLV919 |
| EAAAK | 12,795 | WMSV_P03359_3mutA |
| EAAAKGSSGGS | 12,796 | MLVBM_Q7SVK7_3mutA_WS |
| GGSGGGGSS | 12,797 | MLVMS_P03355_3mutA_WS |
| GGGEAAAKPAP | 12,798 | MLVMS_P03355_3mut |
| EAAAKGGSGGG | 12,799 | XMRV6_A1Z651_3mutA |
| GGGGGSEAAAK | 12,800 | KORV_Q9TTC1-Pro_3mutA |
| GGGGGG | 12,801 | BAEVM_P10272_3mutA |
| GGGGGG | 12,802 | MLVMS_P03355_3mut |
| GGGGGGG | 12,803 | MLVBM_Q7SVK7_3mutA_WS |
| AEAAAKEAAAKEAAAKEAAAKALEAEAAAKEAAAKEAAAKEAAAKA | 12,804 | AVIRE_P03360 |
| PAPGSSGGS | 12,805 | PERV_Q4VFZ2_3mut |
| GGGGGS | 12,806 | XMRV6_A1Z651_3mut |
| EAAAKPAP | 12,807 | XMRV6_A1Z651_3mutA |
| GGG | | MLVMS_P03355_3mutA_WS |
| AEAAAKEAAAKEAAAKEAAAKALEAEAAAKEAAAKEAAAKEAAAKA | 12,809 | FLV_P10273_3mut |
| EAAAKGSSPAP | 12,810 | MLVMS_P03355_3mut |
| SGSETPGTSESATPES | 12,811 | BAEVM_P10272_3mutA |
| GGSPAPEAAAK | 12,812 | MLVMS_P03355_3mut |
| GSSGSSGSSGSS | 12,813 | MLVAV_P03356_3mutA |
| AEAAAKEAAAKEAAAKEAAAKALEAEAAAKEAAAKEAAAKEAAAKA | 12,814 | MLVMS_P03355_3mut |
| GGSPAP | 12,815 | MLVCB_P08361_3mutA |
| GGGGGSEAAAK | 12,816 | MLVMS_P03355_3mutA_WS |
| GGGGG | 12,817 | MLVFF_P26809_3mutA |
| GSSEAAAK | 12,818 | MLVAV_P03356_3mutA |
| GGS | | BAEVM_P10272_3mut |
| EAAAKGGSPAP | 12,820 | MLVCB_P08361_3mutA |
| PAPAPAPAP | 12,821 | FLV_P10273_3mutA |
| PAPGGGEAAAK | 12,822 | MLVCB_P08361_3mutA |
| GGGGSSEAAAK | 12,823 | MLVMS_P03355_3mutA_WS |
| GGGGG | 12,824 | PERV_Q4VFZ2_3mutA_WS |
| GGSGGSGGSGGSGGSGGS | 12,825 | PERV_Q4VFZ2_3mut |
| GGGGG | 12,826 | MLVMS_P03355_3mut |
| PAPEAAAKGGG | 12,827 | MLVBM_Q7SVK7_3mutA_WS |
| GSSGGGPAP | 12,828 | XMRV6_A1Z651_3mutA |
| GSSGSSGSSGSSGSSGSS | 12,829 | PERV_Q4VFZ2_3mutA_WS |
| EAAAKGGSPAP | 12,830 | PERV_Q4VFZ2_3mut |
| GSSGGSEAAAK | 12,831 | MLVMS_P03355_PLV919 |
| GSS | | PERV_Q4VFZ2_3mut |
| EAAAKGGS | 12,833 | WMSV_P03359_3mutA |
| GGGGGSPAP | 12,834 | PERV_Q4VFZ2_3mutA_WS |
| EAAAKGSS | 12,835 | MLVMS_P03355_PLV919 |
| EAAAKGGGGSS | 12,836 | KORV_Q9TTC1-Pro_3mutA |
| PAPGSSGGG | 12,837 | PERV_Q4VFZ2_3mut |
| GGGGSSEAAAK | 12,838 | MLVFF_P26809_3mut |
| PAPAPAP | 12,839 | MLVMS_P03355_3mut |
| GSSGGSEAAAK | 12,840 | XMRV6_A1Z651_3mut |
| PAPEAAAKGSS | 12,841 | MLVMS_P03355_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSGGSGGSGGSGGS | 12,842 | MLVMS_P03355_3mutA_WS |
| GGSGSSPAP | 12,843 | XMRV6_A1Z651_3mutA |
| GGGGSSPAP | 12,844 | MLVMS_P03355_PLV919 |
| GGGGS | 12,845 | MLVCB_P08361_3mutA |
| EAAAKEAAAKEAAAKEAAAK | 12,846 | PERV_Q4VFZ2_3mutA_WS |
| EAAAKEAAAK | 12,847 | KORV_Q9TTC1_3mutA |
| PAPGGGEAAAK | 12,848 | BAEVM_P10272_3mutA |
| GSSGGSEAAAK | 12,849 | XMRV6_A1Z651_3mutA |
| EAAAKEAAAKEAAAKEAAAKEAAAKEAAAK | 12,850 | FLV_P10273_3mut |
| GSSEAAAKPAP | 12,851 | MLVMS_P03355_3mutA_WS |
| EAAAKPAPGSS | 12,852 | PERV_Q4VFZ2_3mutA_WS |
| GSSGGSPAP | 12,853 | XMRV6_A1Z651_3mutA |
| GSSEAAAKGGG | 12,854 | PERV_Q4VFZ2_3mut |
| GGGEAAAKGGS | 12,855 | WMSV_P03359_3mutA |
| GSSEAAAKGGG | 12,856 | MLVFF_P26809_3mut |
| PAPAPAP | 12,857 | KORV_Q9TTC1-Pro_3mutA |
| EAAAKGGSPAP | 12,858 | MLVMS_P03355_3mutA_WS |
| PAPGGSEAAAK | 12,859 | PERV_Q4VFZ2_3mut |
| GGGGS | 12,860 | MLVBM_Q7SVK7_3mutA_WS |
| EAAAKGSSGGG | 12,861 | KORV_Q9TTC1_3mut |
| EAAAKGGGPAP | 12,862 | MLVCB_P08361_3mutA |
| EAAAKGSS | 12,863 | BAEVM_P10272_3mutA |
| GGSPAPGGG | 12,864 | MLVBM_Q7SVK7_3mutA_WS |
| GGGGSEAAAKGGGGS | 12,865 | MLVMS_P03355_3mutA_WS |
| GGGEAAAKGGS | 12,866 | PERV_Q4VFZ2_3mutA_WS |
| EAAAKGGGGSS | 12,867 | MLVMS_P03355_3mutA_WS |
| EAAAKGGGPAP | 12,868 | MLVFF_P26809_3mut |
| GSSPAP | 12,869 | PERV_Q4VFZ2_3mutA_WS |
| EAAAKGGS | 12,870 | MLVMS_P03355_3mut |
| GGGGSS | 12,871 | KORV_Q9TTC1-Pro_3mutA |
| EAAAKGSSPAP | 12,872 | MLVMS_P03355_3mutA_WS |
| GGGPAP | 12,873 | PERV_Q4VFZ2_3mut |
| EAAAKGSSGGS | 12,874 | XMRV6_A1Z651_3mutA |
| PAPGGG | 12,875 | MLVAV_P03356_3mutA |
| GSSPAPEAAAK | 12,876 | BAEVM_P10272_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGPAP | 12,877 | MLVBM_Q7SVK7_3mutA_WS |
| GSSGGGGGS | 12,878 | AVIRE_P03360_3mutA |
| SGSETPGTSESATPES | 12,879 | MLVMS_P03355_PLV919 |
| GGGPAP | 12,880 | MLVFF_P26809_3mut |
| EAAAKGGGGSS | 12,881 | XMRV6_A1Z651_3mutA |
| GGGGSSPAP | 12,882 | XMRV6_A1Z651_3mut |
| GGGGSEAAAKGGGGS | 12,883 | MLVMS_P03355_3mut |
| GSSPAP | 12,884 | MLVBM_Q7SVK7_3mutA_WS |
| GGSGSSEAAAK | 12,885 | FLV_P10273_3mutA |
| SGSETPGTSESATPES | 12,886 | MLVBM_Q7SVK7_3mutA_WS |
| PAPGGG | 12,887 | AVIRE_P03360_3mutA |
| GGGEAAAKPAP | 12,888 | MLVMS_P03355_3mutA_WS |
| EAAAKGGSGSS | 12,889 | PERV_Q4VFZ2_3mut |
| GGSPAPGGG | 12,890 | MLVAV_P03356_3mutA |
| PAPGGSGSS | 12,891 | BAEVM_P10272_3mutA |
| GSSGGSPAP | 12,892 | MLVFF_P26809_3mutA |
| EAAAKGSSGGG | 12,893 | PERV_Q4VFZ2_3mut |
| GGGGSGGGGS | 12,894 | PERV_Q4VFZ2_3mutA_WS |
| GSSGGGGGS | 12,895 | BAEVM_P10272_3mutA |
| GGGGSSGGS | 12,896 | MLVBM_Q7SVK7_3mutA_WS |
| EAAAKGGS | 12,897 | PERV_Q4VFZ2_3mutA_WS |
| GSSGSSGSSGSS | 12,898 | MLVMS_P03355_3mut |
| GGS | | MLVMS_P03355_3mutA_WS |
| GSSGGSEAAAK | 12,900 | MLVBM_Q7SVK7_3mutA_WS |
| SGGSSGGSSGSETPGTSESATPESSGGSSGGSS | 12,901 | XMRV6_A1Z651 |
| GGGGG | 12,902 | FLV_P10273_3mutA |
| PAPEAAAKGSS | 12,903 | PERV_Q4VFZ2_3mut |
| GGGGGG | 12,904 | WMSV_P03359_3mut |
| EAAAKGGG | 12,905 | BAEVM_P10272_3mutA |
| GGGGSS | 12,906 | MLVMS_P03355_3mutA_WS |
| GSSGGGEAAAK | 12,907 | KORV_Q9TTC1_3mut |
| GGSGSS | 12,908 | AVIRE_P03360_3mutA |
| EAAAKPAP | 12,909 | MLVMS_P03355_3mut |
| EAAAKEAAAKEAAAK | 12,910 | FLV_P10273_3mutA |
| GGGG | 12,911 | XMRV6_A1Z651_3mutA |
| GSSPAPGGS | 12,912 | BAEVM_P10272_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSGGGGGS | 12,913 | MLVFF_P26809_3mutA |
| GGGGSSGGS | 12,914 | MLVAV_P03356_3mutA |
| GGS | | PERV_Q4VFZ2_3mut |
| GGGGG | 12,916 | WMSV_P03359_3mutA |
| GSSGSSGSSGSSGSSGSS | 12,917 | FLV_P10273_3mutA |
| PAPGGGGSS | 12,918 | MLVAV_P03356_3mutA |
| GGGGGGGG | 12,919 | BAEVM_P10272_3mutA |
| SGSETPGTSESATPES | 12,920 | MLVCB_P08361_3mutA |
| PAPGGG | 12,921 | BAEVM_P10272_3mutA |
| GSSGSSGSS | 12,922 | MLVCB_P08361_3mutA |
| GGSGSS | 12,923 | MLVMS_P03355_3mutA_WS |
| EAAAKGGGGSEAAAK | 12,924 | WMSV_P03359_3mutA |
| GGGGGGGG | 12,925 | FLV_P10273_3mutA |
| GSSGSS | 12,926 | MLVMS_P03355_3mutA_WS |
| PAPEAAAKGGS | 12,927 | XMRV6_A1Z651_3mutA |
| EAAAKEAAAK | 12,928 | MLVMS_P03355_3mut |
| GGGGSGGGGSGGGGS | 12,929 | BAEVM_P10272_3mutA |
| EAAAKGSSPAP | 12,930 | MLVMS_P03355_PLV919 |
| GGGGSSEAAAK | 12,931 | MLVMS_P03355_3mut |
| GGGGSSEAAAK | 12,932 | BAEVM_P10272_3mutA |
| PAPGGSGSS | 12,933 | PERV_Q4VFZ2_3mut |
| GGSGGGEAAAK | 12,934 | MLVFF_P26809_3mut |
| PAPEAAAKGGS | 12,935 | PERV_Q4VFZ2_3mut |
| GGGPAPGSS | 12,936 | AVIRE_P03360_3mut |
| PAPGGSGGG | 12,937 | PERV_Q4VFZ2_3mutA_WS |
| GGGGGGGG | 12,938 | PERV_Q4VFZ2_3mutA_WS |
| GSSEAAAK | 12,939 | MLVMS_P03355_3mutA_WS |
| GGGGSGGGGSGGGGS | 12,940 | PERV_Q4VFZ2_3mutA_WS |
| EAAAKGGS | 12,941 | MLVMS_P03355_3mut |
| GGGGGSGSS | 12,942 | MLVCB_P08361_3mut |
| GGGPAP | 12,943 | KORV_Q9TTC1-Pro_3mutA |
| EAAAKPAPGGG | 12,944 | MLVCB_P08361_3mut |
| GSSGGSPAP | 12,945 | MLVCB_P08361_3mutA |
| SGGSSGGSSGSETPGTSESATPESSGGSSGGSS | 12,946 | MLVMS_P03355_3mut |
| PAPAPAPAP | 12,947 | MLVMS_P03355_3mut |
| GSSGGS | 12,948 | XMRV6_A1Z651_3mutA |
| GSSEAAAKGGG | 12,949 | MLVMS_P03355_3mut |
| GGSGSSPAP | 12,950 | MLVMS_P03355_3mutA_WS |
| GSSEAAAKGGS | 12,951 | MLVMS_P03355_PLV919 |
| EAAAKEAAAKEAAAKEAAAKEAAAK | 12,952 | BAEVM_P10272_3mut |
| PAPGGGGSS | 12,953 | KORV_Q9TTC1_3mutA |
| EAAAKGSS | 12,954 | MLVMS_P03355_3mutA_WS |
| AEAAAKEAAAKEAAAKEAAAKALEAEAAAKEAAAKEAAAKEAAAKA | 12,955 | FFV_O93209_2mut |
| GGSGGSGGSGGSGGSGGS | 12,956 | BAEVM_P10272_3mutA |
| GGGGGG | 12,957 | MLVMS_P03355_PLV919 |
| PAPEAAAK | 12,958 | BAEVM_P10272_3mutA |
| GGSGSSEAAAK | 12,959 | MLVAV_P03356_3mutA |
| GGG | | MLVCB_P08361_3mutA |
| GGGGG | 12,961 | MLVCB_P08361_3mutA |
| GGSGGSGGSGGS | 12,962 | KORV_Q9TTC1-Pro_3mutA |
| GSSGSSGSSGSSGSSGSS | 12,963 | XMRV6_A1Z651_3mutA |
| GSSEAAAKPAP | 12,964 | FLV_P10273_3mutA |
| GGGEAAAKPAP | 12,965 | MLVCB_P08361_3mutA |
| GSSGSSGSS | 12,966 | MLVMS_P03355_3mutA_WS |
| PAPAPAPAP | 12,967 | MLVMS_P03355_PLV919 |
| EAAAKGGG | 12,968 | MLVMS_P03355_PLV919 |
| PAPAPAPAPAPAP | 12,969 | FLV_P10273_3mutA |
| EAAAKGGSGSS | 12,970 | MLVMS_P03355_3mut |
| GGGGGG | 12,971 | PERV_Q4VFZ2_3mutA_WS |
| PAPGGG | 12,972 | MLVCB_P08361_3mutA |
| GGGGGSGSS | 12,973 | KORV_Q9TTC1_3mutA |
| GGGGSGGGGSGGGGSGGGGS | 12,974 | XMRV6_A1Z651_3mut |
| GGSGGSGGS | 12,975 | KORV_Q9TTC1-Pro_3mutA |
| EAAAKPAPGGG | 12,976 | MLVMS_P03355_3mutA_WS |
| AEAAAKEAAAKEAAAKEAAAKALEAEAAAKEAAAKEAAAKEAAAKA | 12,977 | XMRV6_A1Z651 |
| GGGGSGGGGSGGGGSGGGGSGGGGSGGGGS | 12,978 | FLV_P10273_3mutA |
| EAAAKGGGGSEAAAK | 12,979 | PERV_Q4VFZ2_3mutA_WS |
| GGGPAPGSS | 12,980 | AVIRE_P03360_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGGG | 12,981 | MLVMS_P03355_3mutA_WS |
| GGGGSGGGGSGGGGSGGGGSGGGGSGGGGS | 12,982 | MLVMS_P03355_3mut |
| GGGGSGGGGS | 12,983 | MLVMS_P03355_3mutA_WS |
| EAAAKGGSPAP | 12,984 | XMRV6_A1Z651_3mutA |
| EAAAKGSSPAP | 12,985 | AVIRE_P03360_3mutA |
| PAPGGSGSS | 12,986 | KORV_Q9TTC1-Pro_3mutA |
| GSS | | MLVBM_Q7SVK7_3mutA_WS |
| GSS | | WMSV_P03359_3mut |
| GGGPAPGSS | 12,989 | MLVFF_P26809_3mutA |
| EAAAKPAP | 12,990 | MLVMS_P03355_3mut |
| GSSPAPEAAAK | 12,991 | FLV_P10273_3mutA |
| GGSPAPGSS | 12,992 | MLVBM_Q7SVK7_3mutA_WS |
| GGGGGSEAAAK | 12,993 | XMRV6_A1Z651_3mut |
| PAPEAAAKGGG | 12,994 | WMSV_P03359_3mutA |
| PAPGGG | 12,995 | PERV_Q4VFZ2_3mut |
| GGSPAPEAAAK | 12,996 | WMSV_P03359_3mutA |
| GGSGGGGSS | 12,997 | PERV_Q4VFZ2_3mut |
| EAAAKGGGGSS | 12,998 | PERV_Q4VFZ2_3mut |
| EAAAKGGSPAP | 12,999 | AVIRE_P03360_3mut |
| GGSGGGGSS | 13,000 | WMSV_P03359_3mutA |
| PAPGSSEAAAK | 13,001 | MLVFF_P26809_3mut |
| GSSEAAAK | 13,002 | MLVMS_P03355_PLV919 |
| GSAGSAAGSGEF | 13,003 | AVIRE_P03360_3mutA |
| EAAAKGGSGSS | 13,004 | MLVMS_P03355_3mut |
| GGSEAAAKPAP | 13,005 | MLVMS_P03355_PLV919 |
| GGGGSGGGGSGGGGSGGGGSGGGGS | 13,006 | MLVFF_P26809_3mutA |
| PAPGSSEAAAK | 13,007 | PERV_Q4VFZ2_3mutA_WS |
| GGGGSSPAP | 13,008 | MLVMS_P03355_3mutA_WS |
| PAPAPAP | 13,009 | MLVCB_P08361_3mutA |
| EAAAKPAPGGG | 13,010 | MLVBM_Q7SVK7_3mutA_WS |
| GGGPAPGSS | 13,011 | BAEVM_P10272_3mutA |
| PAP | | MLVMS_P03355_3mutA_WS |
| PAPGGSGGG | 13,013 | MLVMS_P03355_3mutA_WS |
| GGSGGSGGSGGSGGS | 13,014 | MLVBM_Q7SVK7_3mutA_WS |
| PAPAPAPAP | 13,015 | XMRV6_A1Z651_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSPAPGGG | 13,016 | MLVMS_P03355_3mutA_WS |
| GSSPAPGGG | 13,017 | MLVMS_P03355_3mut |
| PAPGGG | 13,018 | MLVMS_P03355_PLV919 |
| GGGEAAAKGSS | 13,019 | WMSV_P03359_3mut |
| EAAAKGSS | 13,020 | KORV_Q9TTC1-Pro_3mutA |
| EAAAKGGS | 13,021 | PERV_Q4VFZ2_3mut |
| EAAAKEAAAKEAAAKEAAAKEAAAK | 13,022 | PERV_Q4VFZ2_3mut |
| PAPEAAAKGGG | 13,023 | MLVMS_P03355_PLV919 |
| EAAAKGSSGGG | 13,024 | MLVFF_P26809_3mut |
| AEAAAKEAAAKEAAAKEAAAKALEAEAAAKEAAAKEAAAKEAAAKA | 13,025 | PERV_Q4VFZ2 |
| EAAAKEAAAKEAAAKEAAAKEAAAKEAAAK | 13,026 | MLVAV_P03356_3mutA |
| GSSGGSGGG | 13,027 | MLVFF_P26809_3mut |
| GSSGSSGSSGSS | 13,028 | PERV_Q4VFZ2_3mutA_WS |
| GGSPAPGGG | 13,029 | MLVMS_P03355_PLV919 |
| GSS | | BAEVM_P10272_3mut |
| GGGPAPGSS | 13,031 | MLVMS_P03355_3mutA_WS |
| GGGGSS | 13,032 | KORV_Q9TTC1_3mutA |
| GSSGGSGGG | 13,033 | BAEVM_P10272_3mutA |
| EAAAKEAAAKEAAAK | 13,034 | MLVCB_P08361_3mutA |
| SGGSSGGSSGSETPGTSESATPESSGGSSGGSS | 13,035 | FLV_P10273_3mutA |
| PAPGGGGGS | 13,036 | PERV_Q4VFZ2_3mut |
| PAPAPAPAPAP | 13,037 | KORV_Q9TTC1-Pro_3mutA |
| EAAAK | 13,038 | MLVMS_P03355_3mutA_WS |
| GGG | | MLVCB_P08361_3mut |
| GGSEAAAKGGG | 13,040 | BAEVM_P10272_3mutA |
| GGGGGSGSS | 13,041 | MLVAV_P03356_3mutA |
| EAAAKGSSPAP | 13,042 | MLVBM_Q7SVK7_3mutA_WS |
| GGSGGSGGS | 13,043 | XMRV6_A1Z651_3mut |
| EAAAKPAPGGG | 13,044 | KORV_Q9TTC1-Pro_3mutA |
| GGGPAPEAAAK | 13,045 | FLV_P10273_3mutA |
| GGSPAPEAAAK | 13,046 | MLVMS_P03355_3mutA_WS |
| GGSGGSGGSGGSGGS | 13,047 | MLVFF_P26809_3mut |
| EAAAKGGSGSS | 13,048 | MLVMS_P03355_PLV919 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGEAAAKGGS | 13,049 | MLVBM_Q7SVK7_3mutA_WS |
| PAPAPAPAP | 13,050 | BAEVM_P10272_3mutA |
| EAAAKEAAAKEAAAKEAAAK | 13,051 | MLVMS_P03355_3mut |
| EAAAKPAP | 13,052 | XMRV6_A1Z651_3mut |
| EAAAKEAAAK | 13,053 | MLVBM_Q7SVK7_3mutA_WS |
| EAAAKGGG | 13,054 | BAEVM_P10272_3mut |
| EAAAKGSS | 13,055 | MLVAV_P03356_3mutA |
| EAAAKEAAAKEAAAKEAAAKEAAAKEAAAK | 13,056 | MLVFF_P26809_3mut |
| GGGPAPGSS | 13,057 | PERV_Q4VFZ2_3mutA_WS |
| GGGG | 13,058 | PERV_Q4VFZ2_3mut |
| EAAAKGGSGSS | 13,059 | MLVMS_P03355_PLV919 |
| GGGGSGGGGSGGGGS | 13,060 | MLVMS_P03355_3mutA_WS |
| EAAAK | 13,061 | MLVMS_P03355_3mutA_WS |
| GGGGSS | 13,062 | PERV_Q4VFZ2 |
| PAPEAAAKGGS | 13,063 | MLVCB_P08361_3mut |
| GSS | | MLVMS_P03355_3mut |
| GSAGSAAGSGEF | 13,065 | MLVFF_P26809_3mutA |
| EAAAKEAAAKEAAAKEAAAKEAAAKEAAAK | 13,066 | KORV_Q9TTC1-Pro_3mut |
| GGGGSGGGGS | 13,067 | AVIRE_P03360_3mutA |
| EAAAK | 13,068 | MLVMS_P03355_3mut |
| GGGPAPGGS | 13,069 | PERV_Q4VFZ2_3mut |
| GGGGSGGGGSGGGGS | 13,070 | MLVMS_P03355_PLV919 |
| PAPGGG | 13,071 | MLVMS_P03355_3mutA_WS |
| GGGEAAAKPAP | 13,072 | PERV_Q4VFZ2_3mutA_WS |
| EAAAKPAPGSS | 13,073 | KORV_Q9TTC1-Pro_3mutA |
| PAPGSS | 13,074 | KORV_Q9TTC1_3mutA |
| GSAGSAAGSGEF | 13,075 | PERV_Q4VFZ2_3mut |
| PAPGGGSS | 13,076 | KORV_Q9TTC1-Pro_3mutA |
| GSSGGGEAAAK | 13,077 | MLVCB_P08361_3mutA |
| GSS | | AVIRE_P03360_3mutA |
| GSSGSSGSSGSS | 13,079 | XMRV6_A1Z651_3mutA |
| PAPEAAAKGGG | 13,080 | MLVMS_P03355_PLV919 |
| GGGPAPEAAAK | 13,081 | MLVCB_P08361_3mutA |
| PAPGGGGGS | 13,082 | MLVCB_P08361_3mutA |
| EAAAKEAAAKEAAAKEAAAK | 13,083 | PERV_Q4VFZ2_3mutA_WS |
| GGGGGSPAP | 13,084 | MLVFF_P26809_3mutA |
| GSSGSSGSSGSSGSS | 13,085 | PERV_Q4VFZ2 |
| GSSPAPEAAAK | 13,086 | MLVMS_P03355_PLV919 |
| GSSGSSGSSGSSGSSGSS | 13,087 | MLVBM_Q7SVK7_3mutA_WS |
| GSSGSSGSSGSSGSSGSS | 13,088 | MLVMS_P03355_3mutA_WS |
| GGSPAPEAAAK | 13,089 | MLVAV_P03356_3mutA |
| GSSGGG | 13,090 | BAEVM_P10272_3mut |
| EAAAKGSSGGS | 13,091 | KORV_Q9TTC1-Pro_3mutA |
| GGSGSSEAAAK | 13,092 | MLVMS_P03355_3mutA_WS |
| GGGPAPEAAAK | 13,093 | MLVFF_P26809_3mutA |
| GGGPAPGGS | 13,094 | MLVMS_P03355_3mutA_WS |
| GGGGG | 13,095 | MLVMS_P03355_PLV919 |
| GGGEAAAKPAP | 13,096 | MLVBM_Q7SVK7_3mutA_WS |
| GGGGGGGGS | 13,097 | WMSV_P03359_3mut |
| GGGPAPEAAAK | 13,098 | PERV_Q4VFZ2_3mut |
| GGSGSSEAAAK | 13,099 | MLVMS_P03355_PLV919 |
| EAAAKGGGPAP | 13,100 | MLVMS_P03355_3mutA_WS |
| GSSGSSGSSGSSGSS | 13,101 | KORV_Q9TTC1-Pro_3mutA |
| PAPAP | 13,102 | WMSV_P03359_3mutA |
| GGSPAPGSS | 13,103 | MLVAV_P03356_3mutA |
| GGSGGGPAP | 13,104 | MLVMS_P03355_3mut |
| GGSPAP | 13,105 | MLVMS_P03355_PLV919 |
| EAAAKGGSPAP | 13,106 | PERV_Q4VFZ2_3mut |
| GSSPAPGGG | 13,107 | KORV_Q9TTC1-Pro_3mutA |
| GSAGSAAGSGEF | 13,108 | MLVMS_P03355_3mut |
| GGSPAP | 13,109 | PERV_Q4VFZ2_3mut |
| GSSGSS | 13,110 | KORV_Q9TTC1-Pro_3mut |
| GGGPAPGSS | 13,111 | MLVMS_P03355_3mutA_WS |
| AEAAAKEAAAKEAAAKEAAAKALEAEAAAKEAAAKEAAAKEAAAKA | 13,112 | FOAMV_P14350 |
| PAPGSSGGG | 13,113 | MLVMS_P03355_PLV919 |
| GGSEAAAKPAP | 13,114 | BAEVM_P10272_3mutA |
| GGGGGS | 13,115 | MLVCB_P08361_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| PAPEAAAKGGS | 13,116 | MLVMS_P03355_3mutA_WS |
| EAAAKEAAAKEAAAKEAAAKEAAAKEAAAK | 13,117 | BAEVM_P10272_3mutA |
| GGSEAAAK | 13,118 | BAEVM_P10272_3mutA |
| GSSPAPEAAAK | 13,119 | MLVMS_P03355_3mutA_WS |
| PAPGGG | 13,120 | WMSV_P03359_3mut |
| EAAAKPAP | 13,121 | PERV_Q4VFZ2_3mut |
| GSSGSSGSSGSSGSS | 13,122 | WMSV_P03359_3mut |
| PAPGGG | 13,123 | MLVBM_Q7SVK7_3mutA_WS |
| GGSGGGEAAAK | 13,124 | BAEVM_P10272_3mutA |
| PAPGGS | 13,125 | MLVMS_P03355_3mut |
| GGSGGSGGSGGS | 13,126 | MLVBM_Q7SVK7_3mutA_WS |
| EAAAKEAAAKEAAAKEAAAK | 13,127 | PERV_Q4VFZ2_3mut |
| GGSEAAAKGGG | 13,128 | WMSV_P03359_3mutA |
| GGGPAP | 13,129 | BAEVM_P10272_3mutA |
| GGGGSGGGGSGGGGSGGGGSGGGGGSGGGGS | 13,130 | XMRV6_A1Z651_3mut |
| GGSPAPGSS | 13,131 | KORV_Q9TTC1_3mut |
| GGGPAPGSS | 13,132 | MLVMS_P03355_3mut |
| GGGGSSGGS | 13,133 | BAEVM_P10272_3mutA |
| GGGEAAAKGSS | 13,134 | KORV_Q9TTC1-Pro_3mutA |
| PAPAP | 13,135 | MLVBM_Q7SVK7_3mutA_WS |
| GGSPAPGGG | 13,136 | PERV_Q4VFZ2_3mut |
| PAPGSS | 13,137 | PERV_Q4VFZ2_3mutA_WS |
| GSSGGSPAP | 13,138 | MLVBM_Q7SVK7_3mutA_WS |
| EAAAKGGGGSEAAAK | 13,139 | PERV_Q4VFZ2_3mut |
| GSSEAAAKGGS | 13,140 | KORV_Q9TTC1-Pro_3mut |
| PAPAPAPAP | 13,141 | KORV_Q9TTC1-Pro_3mutA |
| GGSEAAAKPAP | 13,142 | WMSV_P03359_3mutA |
| PAPGGS | 13,143 | FLV_P10273_3mutA |
| EAAAKGGGPAP | 13,144 | PERV_Q4VFZ2_3mut |
| GGSGSSGGG | 13,145 | AVIRE_P03360_3mutA |
| EAAAKGGSGSS | 13,146 | BAEVM_P10272_3mutA |
| SGGSSGGSSGSETPGTSESATPESSGGSSGGSS | 13,147 | MLVCB_P08361_3mutA |
| GSSEAAAKGGS | 13,148 | XMRV6_A1Z651_3mutA |
| GGGGG | 13,149 | BAEVM_P10272_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGGSGGGGSGGGGSGGGGSGGGGGSGGGGS | 13,150 | SFV3L_P27401_2mutA |
| GGGEAAAKGSS | 13,151 | MLVMS_P03355_PLV919 |
| EAAAKGGGGSEAAAK | 13,152 | KORV_Q9TTC1_3mutA |
| EAAAKGGG | 13,153 | AVIRE_P03360_3mut |
| GGSGGG | 13,154 | MLVMS_P03355_3mutA_WS |
| GGSGSSGGG | 13,155 | MLVMS_P03355_PLV919 |
| GGGGSGGGGSGGGGGGGGSGGGGSGGGGS | 13,156 | KORV_Q9TTC1_3mut |
| GGGGSEAAAKGGGGS | 13,157 | KORV_Q9TTC1_3mutA |
| PAPAPAPAPAP | 13,158 | FLV_P10273_3mutA |
| GGS | | MLVBM_Q7SVK7_3mutA_WS |
| GGGGGSEAAAK | 13,160 | MLVBM_Q7SVK7_3mutA_WS |
| GSSGSSGSSGSSGSS | 13,161 | MLVMS_P03355_3mutA_WS |
| EAAAKEAAAKEAAAKEAAAKEAAAK | 13,162 | MLVMS_P03355_3mut |
| GGSGSSGGG | 13,163 | PERV_Q4VFZ2_3mut |
| PAP | | MLVFF_P26809_3mut |
| GSSPAPEAAAK | 13,165 | MLVAV_P03356_3mutA |
| EAAAKGGGGSS | 13,166 | MLVMS_P03355_3mut |
| GGGEAAAKGGS | 13,167 | XMRV6_A1Z651_3mut |
| GGSGGGPAP | 13,168 | MLVBM_Q7SVK7_3mutA_WS |
| GSAGSAAGSGEF | 13,169 | BAEVM_P10272_3mutA |
| GSSEAAAK | 13,170 | MLVCB_P08361_3mut |
| PAPGSS | 13,171 | MLVMS_P03355_3mut |
| EAAAKEAAAKEAAAK | 13,172 | MLVAV_P03356_3mutA |
| GSAGSAAGSGEF | 13,173 | XMRV6_A1Z651_3mutA |
| GSSGSSGSSGSS | 13,174 | BAEVM_P10272_3mutA |
| AEAAAKEAAAKEAAAKEAAAKALEAEAAAKEAAAKEAAAKEAAAKA | 13,175 | KORV_Q9TTC1-Pro_3mut |
| GGGGSSEAAAK | 13,176 | WMSV_P03359_3mut |
| GSSGGGEAAAK | 13,177 | MLVBM_Q7SVK7_3mutA_WS |
| EAAAKPAP | 13,178 | MLVFF_P26809_3mutA |
| GGSPAPGGG | 13,179 | KORV_Q9TTC1_3mutA |
| PAPEAAAK | 13,180 | FLV_P10273_3mutA |
| GSSGSSGSS | 13,181 | MLVBM_Q7SVK7_3mutA_WS |
| GSSGGGEAAAK | 13,182 | FLV_P10273_3mutA |
| GGSPAP | 13,183 | MLVBM_Q7SVK7_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSAGSAAGSGEF | 13,184 | KORV_Q9TTC1-Pro_3mutA |
| PAPGGSEAAAK | 13,185 | MLVMS_P03355_PLV919 |
| GGSPAPEAAAK | 13,186 | MLVBM_Q7SVK7_3mutA_WS |
| GGGGGSPAP | 13,187 | MLVBM_Q7SVK7_3mutA_WS |
| EAAAKGSSPAP | 13,188 | WMSV_P03359_3mut |
| EAAAKGGGPAP | 13,189 | MLVBM_Q7SVK7_3mutA_WS |
| PAPGSS | 13,190 | KORV_Q9TTC1-Pro_3mutA |
| GGSGSSGGG | 13,191 | BAEVM_P10272_3mut |
| SGGSSGGSSGSETPGTSESATPESSGGSSGGSS | 13,192 | FFV_O93209-Pro_2mut |
| GGSGGSGGSGGSGGSGGS | 13,193 | WMSV_P03359_3mutA |
| GGSGGSGGS | 13,194 | PERV_Q4VFZ2_3mutA_WS |
| GGGGG | 13,195 | PERV_Q4VFZ2_3mutA_WS |
| GGGPAP | 13,196 | FLV_P10273_3mutA |
| PAPGGSGGG | 13,197 | XMRV6_A1Z651_3mutA |
| GGGGSEAAAKGGGGS | 13,198 | XMRV6_A1Z651_3mut |
| EAAAKGSSGGG | 13,199 | KORV_Q9TTC1-Pro_3mutA |
| GSSGGSEAAAK | 13,200 | WMSV_P03359_3mut |
| EAAAKGGSGSS | 13,201 | PERV_Q4VFZ2_3mut |
| PAPAPAPAPAP | 13,202 | PERV_Q4VFZ2_3mut |
| GGGGSGGGGSGGGGSGGGGSGGGGGSGGGGS | 13,203 | MLVMS_P03355_3mutA_WS |
| GGGGGGG | 13,204 | KORV_Q9TTC1_3mutA |
| EAAAK | 13,205 | KORV_Q9TTC1-Pro_3mutA |
| GGGEAAAKGGS | 13,206 | KORV_Q9TTC1-Pro_3mutA |
| GGGEAAAKGGS | 13,207 | PERV_Q4VFZ2_3mutA_WS |
| GGGGGSPAP | 13,208 | XMRV6_A1Z651_3mut |
| GGGGSGGGGSGGGGSGGGGS | 13,209 | MLVFF_P26809_3mut |
| GGGGGGG | 13,210 | MLVFF_P26809_3mut |
| PAPAPAPAPAPAP | 13,211 | AVIRE_P03360_3mutA |
| GSSPAPGGG | 13,212 | FLV_P10273_3mutA |
| GGGGGSPAP | 13,213 | MLVMS_P03355_3mutA_WS |
| GGGGSGGGGSGGGGS | 13,214 | MLVMS_P03355_3mut |
| GGGGSGGGGSGGGGS | 13,215 | KORV_Q9TTC1_3mut |
| GSSEAAAKGGS | 13,216 | MLVAV_P03356_3mutA |
| GSSGSSGSSGSSGSS | 13,217 | MLVMS_P03355_3mut |
| EAAAKGGGGGS | 13,218 | PERV_Q4VFZ2_3mutA_WS |
| GSSGGGGGS | 13,219 | PERV_Q4VFZ2_3mut |
| GGGEAAAKPAP | 13,220 | MLVMS_P03355_3mut |
| GSSGGSPAP | 13,221 | PERV_Q4VFZ2_3mutA_WS |
| GSSGGGPAP | 13,222 | BAEVM_P10272_3mutA |
| GGGGGSGSS | 13,223 | MLVMS_P03355_PLV919 |
| AEAAAKEAAAKEAAAKEAAAKALEAEAAAKEAAAKEAAAKEAAAKA | 13,224 | BAEVM_P10272_3mut |
| PAPEAAAK | 13,225 | MLVMS_P03355_3mut |
| GGGGSGGGGSGGGGS | 13,226 | FLV_P10273_3mutA |
| GGSGSSGGG | 13,227 | WMSV_P03359_3mutA |
| EAAAKGGS | 13,228 | PERV_Q4VFZ2_3mut |
| EAAAKGSSPAP | 13,229 | MLVCB_P08361_3mut |
| EAAAKGGSGSS | 13,230 | WMSV_P03359_3mutA |
| GSSGSS | 13,231 | PERV_Q4VFZ2_3mutA_WS |
| PAPAPAPAP | 13,232 | MLVMS_P03355_PLV919 |
| GGSGGG | 13,233 | PERV_Q4VFZ2_3mutA_WS |
| GSS | | MLVBM_Q7SVK7_3mutA_WS |
| PAP | | KORV_Q9TTC1-Pro_3mutA |
| GGSGSSEAAAK | 13,236 | MLVFF_P26809_3mut |
| PAPEAAAKGSS | 13,237 | KORV_Q9TTC1-Pro_3mutA |
| GGSGGS | 13,238 | MLVCB_P08361_3mutA |
| GGGGGGG | 13,239 | PERV_Q4VFZ2_3mutA_WS |
| GGSPAPEAAAK | 13,240 | MLVBM_Q7SVK7_3mut |
| EAAAKEAAAKEAAAKEAAAKEAAAKEAAAK | 13,241 | KORV_Q9TTC1_3mutA |
| GGSPAP | 13,242 | MLVMS_P03355_3mut |
| GGSEAAAKGGG | 13,243 | PERV_Q4VFZ2_3mut |
| GGGGSGGGGS | 13,244 | FLV_P10273_3mutA |
| GGGEAAAK | 13,245 | BAEVM_P10272_3mutA |
| GGGGSGGGGSGGGGSGGGGSGGGGGSGGGGS | 13,246 | SFV3L_P27401_2mut |
| GGSEAAAKPAP | 13,247 | KORV_Q9TTC1-Pro_3mutA |
| GSSGGGEAAAK | 13,248 | MLVMS_P03355_PLV919 |
| GGGGGSEAAAK | 13,249 | MLVMS_P03355_PLV919 |
| EAAAKGGSGGG | 13,250 | MLVMS_P03355_3mutA_WS |
| GGGGSSPAP | 13,251 | MLVAV_P03356_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKEAAAK | 13,252 | MLVMS_P03355_3mutA_WS |
| AEAAAKEAAAKEAAAKEA AAKALEAEAAAKEAAAKE AAAKEAAAKA | 13,253 | SFV3L_P27401_2mut |
| GSSGSSGSSGSSGSS | 13,254 | MLVMS_P03355_PLV919 |
| GSSGGG | 13,255 | KORV_Q9TTC1-Pro_3mutA |
| GSSGGS | 13,256 | MLVFF_P26809_3mutA |
| GGGGSGGGGS | 13,257 | XMRV6_A1Z651_3mutA |
| PAPGSS | 13,258 | MLVBM_Q7SVK7_3mutA_WS |
| GGGPAPEAAAK | 13,259 | XMRV6_A1Z651_3mutA |
| EAAAKGGS | 13,260 | MLVFF_P26809_3mut |
| GSS | | KORV_Q9TTC1_3mutA |
| GGGG | 13,262 | PERV_Q4VFZ2_3mut |
| GGGGGSEAAAK | 13,263 | AVIRE_P03360_3mutA |
| GSSGSSGSSGSSGSS | 13,264 | MLVMS_P03355_PLV919 |
| PAPGGSGGG | 13,265 | PERV_Q4VFZ2_3mut |
| GGGPAP | 13,266 | PERV_Q4VFZ2_3mut |
| GGGPAPEAAAK | 13,267 | AVIRE_P03360_3mutA |
| GGGEAAAK | 13,268 | MLVCB_P08361_3mut |
| GGG | | MLVFF_P26809_3mutA |
| EAAAKPAPGSS | 13,270 | XMRV6_A1Z651_3mutA |
| GGSGSSEAAAK | 13,271 | PERV_Q4VFZ2_3mutA_WS |
| EAAAKGSS | 13,272 | MLVMS_P03355_3mut |
| GGSGSSEAAAK | 13,273 | BAEVM_P10272_3mut |
| GGSGGG | 13,274 | MLVBM_Q7SVK7_3mutA_WS |
| GGGPAP | 13,275 | MLVMS_P03355_PLV919 |
| GGSPAPGGG | 13,276 | PERV_Q4VFZ2_3mutA_WS |
| GGGGGSEAAAK | 13,277 | MLVFF_P26809_3mutA |
| EAAAKGSSGGS | 13,278 | MLVBM_Q7SVK7_3mut |
| PAPAP | 13,279 | XMRV6_A1Z651_3mut |
| GSSPAPGGS | 13,280 | MLVBM_Q7SVK7_3mutA_WS |
| GSSEAAAKGGG | 13,281 | WMSV_P03359_3mutA |
| EAAAKGGGGGS | 13,282 | PERV_Q4VFZ2_3mut |
| GSSGSSGSSGSSGSS | 13,283 | MLVCB_P08361_3mutA |
| EAAAKGGGGSS | 13,284 | PERV_Q4VFZ2_3mut |
| EAAAKGSS | 13,285 | PERV_Q4VFZ2_3mut |
| EAAAKEAAAKEAAAKEAA AKEAAAKEAAAK | 13,286 | AVIRE_P03360_3mutA |
| EAAAKGGS | 13,287 | MLVCB_P08361_3mut |
| GSSGGSEAAAK | 13,288 | MLVAV_P03356_3mutA |
| EAAAKPAPGGS | 13,289 | PERV_Q4VFZ2_3mut |
| GGSGGS | 13,290 | MLVAV_P03356_3mutA |
| EAAAKGSSGGG | 13,291 | AVIRE_P03360_3mutA |
| GGSGGSGGSGGS | 13,292 | PERV_Q4VFZ2_3mut |
| GGGGGGGG | 13,293 | KORV_Q9TTC1_3mutA |
| GGSGSSEAAAK | 13,294 | MLVCB_P08361_3mutA |
| EAAAKGGG | 13,295 | MLVBM_Q7SVK7_3mutA_WS |
| GGGGSGGGGSGGGGS | 13,296 | MLVCB_P08361_3mut |
| GGSGGSGGSGGS | 13,297 | PERV_Q4VFZ2_3mutA_WS |
| PAPAPAPAPAP | 13,298 | WMSV_P03359_3mut |
| EAAAKEAAAKEAAAKEAA AK | 13,299 | PERV_Q4VFZ2_3mut |
| GGSGGSGGS | 13,300 | XMRV6_A1Z651_3mutA |
| PAPGGGGSS | 13,301 | BAEVM_P10272_3mutA |
| GSSEAAAKGGS | 13,302 | MLVCB_P08361_3mut |
| GSSGGGPAP | 13,303 | MLVCB_P08361_3mutA |
| GGSGSS | 13,304 | MLVBM_Q7SVK7_3mutA_WS |
| GGGGGSEAAAK | 13,305 | MLVAV_P03356_3mutA |
| GSSEAAAK | 13,306 | PERV_Q4VFZ2_3mutA_WS |
| GGGGGSGSS | 13,307 | MLVBM_Q7SVK7_3mutA_WS |
| EAAAKGGSGSS | 13,308 | MLVFF_P26809_3mut |
| PAP | | FLV_P10273_3mutA |
| GGGGG | 13,310 | MLVMS_P03355_3mutA_WS |
| EAAAK | 13,311 | PERV_Q4VFZ2_3mut |
| GSS | | FLV_P10273_3mutA |
| PAPAPAPAPAPAP | 13,313 | KORV_Q9TTC1-Pro_3mutA |
| EAAAKEAAAKEAAAKEAA AK | 13,314 | MLVCB_P08361_3mut |
| EAAAKGGGGSEAAAK | 13,315 | XMRV6_A1Z651_3mut |
| PAPGGSGGG | 13,316 | MLVBM_Q7SVK7_3mutA_WS |
| GGSGGGPAP | 13,317 | WMSV_P03359_3mutA |
| GGGGSSEAAAK | 13,318 | MLVBM_Q7SVK7_3mutA_WS |
| PAPGGGGSS | 13,319 | MLVCB_P08361_3mut |
| GGSGGSGGSGGS | 13,320 | PERV_Q4VFZ2_3mutA_WS |
| PAPGGSGGG | 13,321 | MLVMS_P03355_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSPAPGGS | 13,322 | MLVCB_P08361_3mutA |
| GSSGSSGSS | 13,323 | MLVFF_P26809_3mut |
| PAPGGGGGS | 13,324 | MLVBM_Q7SVK7_3mutA_WS |
| GSSPAP | 13,325 | PERV_Q4VFZ2_3mut |
| GGSGGG | 13,326 | KORV_Q9TTC1-Pro_3mut |
| EAAAKGGGGSEAAAK | 13,327 | PERV_Q4VFZ2_3mutA_WS |
| GGSPAPEAAAK | 13,328 | PERV_Q4VFZ2_3mutA_WS |
| EAAAKPAP | 13,329 | BAEVM_P10272_3mut |
| GGGGSGGGGSGGGGGGGGSGGGGSGGGGS | 13,330 | MLVMS_P03355_3mut |
| EAAAKGGGGSS | 13,331 | MLVFF_P26809_3mut |
| EAAAKEAAAK | 13,332 | MLVCB_P08361_3mut |
| GSSEAAAKGGS | 13,333 | PERV_Q4VFZ2_3mut |
| GGSPAP | 13,334 | KORV_Q9TTC1-Pro_3mutA |
| EAAAKEAAAKEAAAKEAAAK | 13,335 | MLVMS_P03355_3mutA_WS |
| GSSGSSGSSGSSGSS | 13,336 | BAEVM_P10272_3mut |
| PAPEAAAK | 13,337 | MLVMS_P03355_3mut |
| GSSGGSPAP | 13,338 | PERV_Q4VFZ2 |
| GGGPAPGGS | 13,339 | BAEVM_P10272_3mutA |
| EAAAKPAPGGS | 13,340 | MLVMS_P03355_PLV919 |
| GGGGSGGGGS | 13,341 | PERV_Q4VFZ2 |
| GGGEAAAK | 13,342 | KORV_Q9TTC1-Pro_3mut |
| EAAAKGGGGGS | 13,343 | FLV_P10273_3mutA |
| GGSPAPGSS | 13,344 | MLVMS_P03355_3mut |
| GSSPAPEAAAK | 13,345 | MLVMS_P03355_3mutA_WS |
| GSAGSAAGSGEF | 13,346 | MLVBM_Q7SVK7_3mutA_WS |
| EAAAK | 13,347 | BAEVM_P10272_3mutA |
| EAAAKGGGGSS | 13,348 | BAEVM_P10272_3mutA |
| GGG | | WMSV_P03359_3mut |
| GGSGSSPAP | 13,350 | BAEVM_P10272_3mut |
| GGSEAAAKPAP | 13,351 | MLVBM_Q7SVK7_3mutA_WS |
| EAAAKGGSGSS | 13,352 | MLVCB_P08361_3mut |
| PAPGSS | 13,353 | MLVAV_P03356_3mutA |
| PAPEAAAKGGG | 13,354 | MLVCB_P08361_3mutA |
| AEAAAKEAAAKEAAAKEAAAKALEAEAAAKEAAAKEAAAKEAAAKA | 13,355 | FOAMV_P14350-Pro_2mut |
| GSSGSSGSS | 13,356 | PERV_Q4VFZ2_3mut |
| PAPGGG | 13,357 | MLVMS_P03355_3mut |
| PAPGGS | 13,358 | PERV_Q4VFZ2_3mut |
| GSSGGG | 13,359 | MLVMS_P03355_PLV919 |
| GSSGSSGSSGSSGSSGSS | 13,360 | WMSV_P03359_3mut |
| PAP | | AVIRE_P03360_3mutA |
| EAAAKGSSPAP | 13,362 | MLVBM_Q7SVK7_3mutA_WS |
| GSSGSSGSSGSS | 13,363 | MLVMS_P03355_PLV919 |
| GGGGSGGGGSGGGGSGGGGSGGGGS | 13,364 | AVIRE_P03360 |
| GGGGS | 13,365 | PERV_Q4VFZ2_3mut |
| EAAAKGSSGGG | 13,366 | MLVBM_Q7SVK7_3mutA_WS |
| GGGGGG | 13,367 | KORV_Q9TTC1-Pro_3mut |
| GGSGSSEAAAK | 13,368 | PERV_Q4VFZ2_3mut |
| GSSPAPEAAAK | 13,369 | MLVBM_Q7SVK7_3mutA_WS |
| GGGGSGGGGS | 13,370 | MLVBM_Q7SVK7_3mutA_WS |
| GSSGGGGGS | 13,371 | MLVAV_P03356_3mutA |
| GSAGSAAGSGEF | 13,372 | WMSV_P03359_3mutA |
| GGGEAAAKGSS | 13,373 | BAEVM_P10272_3mutA |
| AEAAAKEAAAKEAAAKEAAAKALEAEAAAKEAAAKEAAAKEAAAKA | 13,374 | FFV_O93209-Pro_2mut |
| PAPGGSGGG | 13,375 | MLVCB_P08361_3mutA |
| EAAAKEAAAKEAAAKEAAAKEAAAK | 13,376 | SFV3L_P27401_2mut |
| GGSGSSPAP | 13,377 | MLVMS_P03355_PLV919 |
| GGGGGG | 13,378 | PERV_Q4VFZ2_3mut |
| EAAAKEAAAKEAAAKEAAAKEAAAK | 13,379 | PERV_Q4VFZ2_3mut |
| EAAAKGSSPAP | 13,380 | MLVFF_P26809_3mut |
| GGGPAPGGS | 13,381 | MLVBM_Q7SVK7_3mutA_WS |
| AEAAAKEAAAKEAAAKEAAAKALEAEAAAKEAAAKEAAAKEAAAKA | 13,382 | SFV3L_P27401 |
| PAP | | PERV_Q4VFZ2_3mut |
| EAAAKGGS | 13,384 | MLVMS_P03355_PLV919 |
| GSSGGSEAAAK | 13,385 | WMSV_P03359_3mutA |
| GGSGSSEAAAK | 13,386 | KORV_Q9TTC1-Pro_3mutA |
| EAAAKEAAAKEAAAK | 13,387 | PERV_Q4VFZ2 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSGGGEAAAK | 13,388 | MLVMS_P03355_3mutA_WS |
| GGGGSGGGGSGGGGSGGGGS | 13,389 | BAEVM_P10272_3mut |
| EAAAKGSS | 13,390 | XMRV6_A1Z651_3mutA |
| GSSGGGGGS | 13,391 | WMSV_P03359_3mutA |
| GSSGSSGSSGSSGSSGSS | 13,392 | MLVFF_P26809_3mutA |
| GGSGSS | 13,393 | MLVAV_P03356_3mutA |
| EAAAKGGGGSEAAAK | 13,394 | MLVMS_P03355_PLV919 |
| EAAAKGGGPAP | 13,395 | PERV_Q4VFZ2 |
| GGSEAAAKGGG | 13,396 | MLVAV_P03356_3mutA |
| EAAAKEAAAKEAAAKEAAAKEAAAKEAAAK | 13,397 | MLVBM_Q7SVK7_3mut |
| EAAAKEAAAKEAAAKEAAAKEAAAKEAAAK | 13,398 | KORV_Q9TTC1-Pro_3mutA |
| GSSPAPEAAAK | 13,399 | MLVFF_P26809_3mutA |
| GGGGSEAAAKGGGGS | 13,400 | PERV_Q4VFZ2_3mut |
| GSSGSSGSSGSS | 13,401 | PERV_Q4VFZ2_3mut |
| GGSEAAAK | 13,402 | MLVFF_P26809_3mutA |
| GGGGGGGG | 13,403 | MLVMS_P03355_3mut |
| GSSGGG | 13,404 | XMRV6_A1Z651_3mutA |
| EAAAKGGS | 13,405 | BAEVM_P10272_3mutA |
| GGGGS | 13,406 | BAEVM_P10272_3mutA |
| GGSEAAAKGGG | 13,407 | KORV_Q9TTC1-Pro_3mutA |
| GGSGSSGGG | 13,408 | KORV_Q9TTC1_3mutA |
| GGSGSSEAAAK | 13,409 | WMSV_P03359_3mut |
| EAAAKGGSGSS | 13,410 | MLVBM_Q7SVK7_3mutA_WS |
| GGS | | BAEVM_P10272_3mutA |
| GGGPAPGSS | 13,412 | WMSV_P03359_3mutA |
| GSSGSSGSSGSSGSS | 13,413 | AVIRE_P03360_3mut |
| GGGEAAAKPAP | 13,414 | XMRV6_A1Z651_3mut |
| GSSGGG | 13,415 | MLVFF_P26809_3mutA |
| GGSPAPGSS | 13,416 | PERV_Q4VFZ2_3mut |
| PAPGGS | 13,417 | MLVCB_P08361_3mut |
| PAPAPAPAPAP | 13,418 | KORV_Q9TTC1_3mutA |
| GSSGGS | 13,419 | MLVCB_P08361_3mutA |
| GSSGGSEAAAK | 13,420 | PERV_Q4VFZ2_3mut |
| EAAAKGSSGGS | 13,421 | MLVMS_P03355_PLV919 |
| EAAAKGGG | 13,422 | WMSV_P03359_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| PAPGGGGGS | 13,423 | BAEVM_P10272_3mutA |
| GGGGSEAAAKGGGGS | 13,424 | WMSV_P03359_3mutA |
| EAAAKEAAAKEAAAKEAAAKEAAAKEAAAK | 13,425 | MLVMS_P03355_3mutA_WS |
| GGS | | KORV_Q9TTC1-Pro_3mutA |
| GSSGGSPAP | 13,427 | BAEVM_P10272_3mutA |
| GGG | | MLVMS_P03355_PLV919 |
| PAPGSS | 13,429 | KORV_Q9TTC1-Pro_3mut |
| GGSEAAAKGGG | 13,430 | FLV_P10273_3mutA |
| GGSEAAAKPAP | 13,431 | PERV_Q4VFZ2_3mutA_WS |
| GGGGSSPAP | 13,432 | XMRV6_A1Z651_3mutA |
| EAAAKEAAAKEAAAKEAAAKEAAAK | 13,433 | PERV_Q4VFZ2_3mutA_WS |
| GGGG | 13,434 | PERV_Q4VFZ2_3mutA_WS |
| GGSEAAAKPAP | 13,435 | MLVMS_P03355_3mut |
| PAPGSSGGG | 13,436 | MLVMS_P03355_3mutA_WS |
| PAPEAAAKGGS | 13,437 | AVIRE_P03360_3mut |
| GGGGSSPAP | 13,438 | MLVMS_P03355_3mutA_WS |
| GGGGSGGGGSGGGGSGGGGS | 13,439 | PERV_Q4VFZ2_3mut |
| GGGEAAAK | 13,440 | MLVMS_P03355_3mut |
| GGGGSS | 13,441 | MLVFF_P26809_3mut |
| GGSPAPGSS | 13,442 | XMRV6_A1Z651_3mut |
| GGGGS | 13,443 | KORV_Q9TTC1-Pro_3mutA |
| EAAAKGSSGGS | 13,444 | FLV_P10273_3mutA |
| GSS | | MLVMS_P03355_PLV919 |
| GGGG | 13,446 | MLVMS_P03355_PLV919 |
| GSSGGS | 13,447 | MLVMS_P03355_PLV919 |
| GGSGGSGGSGGS | 13,448 | MLVMS_P03355_3mut |
| PAPEAAAKGGS | 13,449 | MLVMS_P03355_3mut |
| EAAAKGSSGGG | 13,450 | BAEVM_P10272_3mutA |
| GSSEAAAK | 13,451 | KORV_Q9TTC1-Pro_3mutA |
| GSAGSAAGSGEF | 13,452 | KORV_Q9TTC1_3mutA |
| GGGGGSEAAAK | 13,453 | MLVCB_P08361_3mut |
| GGGG | 13,454 | WMSV_P03359_3mut |
| GGGGSSEAAAK | 13,455 | MLVMS_P03355_PLV919 |
| PAPGGG | 13,456 | WMSV_P03359_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKGGSGGG | 13,457 | MLVAV_P03356_3mutA |
| GGGPAPGGS | 13,458 | MLVMS_P03355_3mut |
| EAAAKPAP | 13,459 | PERV_Q4VFZ2_3mutA_WS |
| GSSGSSGSS | 13,460 | KORV_Q9TTC1-Pro_3mutA |
| GSSPAPGGS | 13,461 | XMRV6_A1Z651_3mut |
| GGGGGSPAP | 13,462 | BAEVM_P10272_3mutA |
| GGSGSSGGG | 13,463 | PERV_Q4VFZ2_3mutA_WS |
| GGGEAAAKGSS | 13,464 | AVIRE_P03360_3mut |
| GSSEAAAK | 13,465 | FLV_P10273_3mutA |
| EAAAK | 13,466 | MLVMS_P03355_3mut |
| EAAAKGGSGSS | 13,467 | WMSV_P03359_3mut |
| GSSEAAAKGGG | 13,468 | PERV_Q4VFZ2_3mut |
| PAPGSSGGG | 13,469 | BAEVM_P10272_3mutA |
| EAAAKGGGGGS | 13,470 | MLVMS_P03355_3mut |
| GGSEAAAKPAP | 13,471 | AVIRE_P03360_3mut |
| GGGPAPGGS | 13,472 | XMRV6_A1Z651_3mut |
| GGGGS | 13,473 | KORV_Q9TTC1_3mutA |
| GGSGGSGGSGGSGGS | 13,474 | XMRV6_A1Z651_3mut |
| GGGPAP | 13,475 | KORV_Q9TTC1-Pro_3mut |
| EAAAKPAP | 13,476 | MLVBM_Q7SVK7_3mutA_WS |
| GGSEAAAK | 13,477 | MLVMS_P03355_PLV919 |
| GSSEAAAKPAP | 13,478 | KORV_Q9TTC1-Pro_3mutA |
| GGSGSS | 13,479 | MLVMS_P03355_3mut |
| EAAAKPAPGGG | 13,480 | PERV_Q4VFZ2_3mut |
| GGSPAPEAAAK | 13,481 | KORV_Q9TTC1_3mutA |
| GGSEAAAKGGG | 13,482 | AVIRE_P03360_3mutA |
| GGGGSEAAAKGGGGS | 13,483 | MLVMS_P03355_PLV919 |
| GSSGGGEAAAK | 13,484 | KORV_Q9TTC1-Pro_3mutA |
| EAAAKGGGPAP | 13,485 | WMSV_P03359_3mut |
| GSSPAP | 13,486 | XMRV6_A1Z651_3mutA |
| AEAAAKEAAAKEAAAKEAAAKALEAEAAAKEAAAKEAAAKEAAAKA | 13,487 | SFV3L_P27401-Pro |
| GGSEAAAKGSS | 13,488 | MLVMS_P03355_PLV919 |
| GSSGGSEAAAK | 13,489 | KORV_Q9TTC1-Pro_3mutA |
| GGSEAAAKGSS | 13,490 | KORV_Q9TTC1-Pro_3mutA |
| EAAAKGGG | 13,491 | AVIRE_P03360_3mutA |
| GSSGGSEAAAK | 13,492 | BAEVM_P10272_3mutA |
| GGGGSEAAAKGGGGS | 13,493 | KORV_Q9TTC1-Pro_3mut |
| PAPGSSEAAAK | 13,494 | MLVMS_P03355_3mut |
| PAPEAAAK | 13,495 | WMSV_P03359_3mut |
| PAPGGSGSS | 13,496 | PERV_Q4VFZ2_3mutA_WS |
| PAPGSS | 13,497 | BAEVM_P10272_3mut |
| PAPGGGGGS | 13,498 | MLVMS_P03355_3mut |
| EAAAKPAPGSS | 13,499 | MLVBM_Q7SVK7_3mutA_WS |
| GSSPAPGGS | 13,500 | MLVMS_P03355_PLV919 |
| GGSGSSEAAAK | 13,501 | MLVMS_P03355_3mut |
| GGGGGG | 13,502 | KORV_Q9TTC1-Pro_3mutA |
| EAAAKEAAAKEAAAKEAAAK | 13,503 | MLVBM_Q7SVK7_3mut |
| GGSPAPGSS | 13,504 | MLVMS_P03355_PLV919 |
| PAPAPAPAPAP | 13,505 | MLVCB_P08361_3mut |
| GGSGSSPAP | 13,506 | WMSV_P03359_3mutA |
| EAAAKGGSGGG | 13,507 | PERV_Q4VFZ2_3mutA_WS |
| GSSGSSGSSGSSGSS | 13,508 | PERV_Q4VFZ2_3mut |
| AEAAAKEAAAKEAAAKEAAAKALEAEAAAKEAAAKEAAAKEAAAKA | 13,509 | KORV_Q9TTC1_3mutA |
| GSSGGGEAAAK | 13,510 | WMSV_P03359_3mutA |
| GSSGGSEAAAK | 13,511 | FLV_P10273_3mutA |
| GGGGGGGG | 13,512 | PERV_Q4VFZ2_3mut |
| PAPGGSEAAAK | 13,513 | FLV_P10273_3mutA |
| GGGGSSPAP | 13,514 | BAEVM_P10272_3mutA |
| PAPAPAPAP | 13,515 | WMSV_P03359_3mut |
| GGSEAAAKPAP | 13,516 | PERV_Q4VFZ2_3mut |
| PAPGGSGGG | 13,517 | BAEVM_P10272_3mutA |
| EAAAKEAAAKEAAAKEAAAKEAAAKEAAAK | 13,518 | MLVMS_P03355_3mut |
| GGGGSGGGGSGGGGS | 13,519 | PERV_Q4VFZ2_3mut |
| GGSGGGPAP | 13,520 | PERV_Q4VFZ2_3mut |
| GGGPAPEAAAK | 13,521 | MLVFF_P26809_3mut |
| GGGGGSGSS | 13,522 | MLVMS_P03355_3mutA_WS |
| GSS | | MLVCB_P08361_3mut |
| GGGGGSPAP | 13,524 | MLVMS_P03355_PLV919 |
| GGSPAP | 13,525 | MLVAV_P03356_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGPAPGGS | 13,526 | KORV_Q9TTC1-Pro_3mutA |
| PAPGSSGGG | 13,527 | FLV_P10273_3mutA |
| PAPGSSGGG | 13,528 | WMSV_P03359_3mutA |
| PAPGGS | 13,529 | MLVBM_Q7SVK7_3mutA_WS |
| GGGEAAAKGSS | 13,530 | PERV_Q4VFZ2_3mutA_WS |
| GGSEAAAKGSS | 13,531 | MLVBM_Q7SVK7_3mutA_WS |
| PAPGGSEAAAK | 13,532 | MLVCB_P08361_3mut |
| GGSEAAAKGGG | 13,533 | XMRV6_A1Z651_3mutA |
| GGSGGGGSS | 13,534 | WMSV_P03359_3mut |
| GGGEAAAKPAP | 13,535 | KORV_Q9TTC1_3mutA |
| EAAAKGSS | 13,536 | KORV_Q9TTC1-Pro_3mut |
| PAPEAAAKGSS | 13,537 | MLVFF_P26809_3mut |
| GSAGSAAGSGEF | 13,538 | PERV_Q4VFZ2_3mut |
| EAAAKGGGGGS | 13,539 | WMSV_P03359_3mut |
| EAAAKGSSPAP | 13,540 | WMSV_P03359_3mutA |
| GGGGSEAAAKGGGGS | 13,541 | XMRV6_A1Z651_3mutA |
| GSSEAAAKPAP | 13,542 | SFV3L_P27401-Pro_2mutA |
| GGGGGG | 13,543 | PERV_Q4VFZ2_3mutA_WS |
| PAPGGS | 13,544 | BAEVM_P10272_3mut |
| PAP | | AVIRE_P03360_3mut |
| PAPAPAP | 13,546 | MLVBM_Q7SVK7_3mutA_WS |
| GGGG | 13,547 | PERV_Q4VFZ2_3mutA_WS |
| GSSGGSEAAAK | 13,548 | MLVBM_Q7SVK7_3mut |
| GGSGGGGSS | 13,549 | MLVFF_P26809_3mut |
| GGGGSSGGS | 13,550 | AVIRE_P03360_3mutA |
| GSSPAPGGG | 13,551 | PERV_Q4VFZ2_3mutA_WS |
| GGSEAAAKPAP | 13,552 | MLVMS_P03355_PLV919 |
| PAP | | KORV_Q9TTC1-Pro_3mut |
| GSSGGS | 13,554 | PERV_Q4VFZ2_3mut |
| GGGGG | 13,555 | PERV_Q4VFZ2_3mut |
| GSSGGGPAP | 13,556 | FLV_P10273_3mutA |
| GSSEAAAKGGG | 13,557 | KORV_Q9TTC1-Pro_3mut |
| EAAAKEAAAKEAAAKEAAAKEAAAKEAAAK | 13,558 | MLVCB_P08361_3mut |
| GGSEAAAKPAP | 13,559 | MLVCB_P08361_3mut |
| PAPAPAPAPAPAP | 13,560 | BAEVM_P10272_3mutA |
| GGGGSEAAAKGGGGS | 13,561 | MLVMS_P03355_3mut |
| EAAAKPAPGSS | 13,562 | MLVMS_P03355_3mut |
| GSSGSSGSSGSSGSS | 13,563 | MLVBM_Q7SVK7_3mutA_WS |
| PAPEAAAKGSS | 13,564 | MLVAV_P03356_3mut |
| AEAAAKEAAAKEAAAKEAAAKALEAEAAAKEAAAKEAAAKEAAAKA | 13,565 | AVIRE_P03360_3mut |
| AEAAAKEAAAKEAAAKEAAAKALEAEAAAKEAAAKEAAAKEAAAKA | 13,566 | PERV_Q4VFZ2_3mut |
| GGSEAAAKGGG | 13,567 | PERV_Q4VFZ2_3mutA_WS |
| GGSGGGGSS | 13,568 | MLVFF_P26809_3mutA |
| PAPEAAAKGSS | 13,569 | MLVCB_P08361_3mut |
| GGG | | PERV_Q4VFZ2_3mutA_WS |
| GGSGGGEAAAK | 13,571 | MLVMS_P03355_3mut |
| EAAAKGGGGSS | 13,572 | WMSV_P03359_3mut |
| GSSPAPGGG | 13,573 | WMSV_P03359_3mutA |
| EAAAKGSSGGG | 13,574 | PERV_Q4VFZ2_3mut |
| GGSGGGEAAAK | 13,575 | PERV_Q4VFZ2_3mutA_WS |
| GGSGGSGGSGGSGGS | 13,576 | PERV_Q4VFZ2_3mutA_WS |
| EAAAKPAPGGS | 13,577 | PERV_Q4VFZ2_3mutA_WS |
| GGGGGSEAAAK | 13,578 | PERV_Q4VFZ2_3mutA_WS |
| GSSPAP | 13,579 | MLVFF_P26809_3mut |
| GGGEAAAKPAP | 13,580 | AVIRE_P03360_3mut |
| GSSGGSEAAAK | 13,581 | MLVMS_P03355_PLV919 |
| EAAAKPAPGGS | 13,582 | WMSV_P03359_3mutA |
| PAPGGG | 13,583 | KORV_Q9TTC1_3mutA |
| EAAAKGSSPAP | 13,584 | KORV_Q9TTC1-Pro_3mut |
| GSSPAPEAAAK | 13,585 | MLVFF_P26809_3mut |
| GGSGGGEAAAK | 13,586 | MLVFF_P26809_3mutA |
| GSSGSSGSS | 13,587 | WMSV_P03359_3mutA |
| EAAAKGGS | 13,588 | BAEVM_P10272_3mut |
| EAAAKPAPGGS | 13,589 | KORV_Q9TTC1_3mutA |
| EAAAKPAPGGS | 13,590 | BAEVM_P10272_3mutA |
| GSSGGGGGS | 13,591 | PERV_Q4VFZ2_3mut |
| PAPGGGGSS | 13,592 | PERV_Q4VFZ2_3mut |
| GSSGSSGSS | 13,593 | WMSV_P03359_3mut |
| EAAAKEAAAKEAAAKEAAAK | 13,594 | WMSV_P03359_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGS | | AVIRE_P03360_3mut |
| EAAAKPAPGSS | 13,596 | MLVFF_P26809_3mut |
| EAAAKGGG | 13,597 | KORV_Q9TTC1_3mut |
| PAPGSSEAAAK | 13,598 | MLVMS_P03355_3mut |
| PAPGSSGGS | 13,599 | MLVMS_P03355_PLV919 |
| GSSPAPEAAAK | 13,600 | MLVMS_P03355_3mut |
| GSSGSSGSSGSSGSSGSS | 13,601 | WMSV_P03359_3mutA |
| GGGGS | 13,602 | BAEVM_P10272_3mut |
| GSSPAP | 13,603 | MLVMS_P03355_3mut |
| EAAAKGGGGSEAAAK | 13,604 | KORV_Q9TTC1-Pro_3mutA |
| EAAAKEAAAK | 13,605 | WMSV_P03359_3mutA |
| GGGGSSGGS | 13,606 | MLVCB_P08361_3mutA |
| PAPGGSEAAAK | 13,607 | BAEVM_P10272_3mut |
| EAAAKGGSPAP | 13,608 | MLVFF_P26809_3mut |
| GSSGGSGGG | 13,609 | MLVBM_Q7SVK7_3mutA_WS |
| GSSGGS | 13,610 | PERV_Q4VFZ2_3mut |
| PAPGGSGSS | 13,611 | PERV_Q4VFZ2_3mutA_WS |
| EAAAKGGSGSS | 13,612 | KORV_Q9TTC1-Pro_3mutA |
| PAPAP | 13,613 | MLVCB_P08361_3mut |
| EAAAKGSSPAP | 13,614 | PERV_Q4VFZ2_3mutA_WS |
| EAAAKPAPGGG | 13,615 | MLVMS_P03355_PLV919 |
| GGGGSGGGGSGGGGGGGG SGGGGSGGGGS | 13,616 | MLVBM_Q7SVK7_3mut |
| EAAAKGGGGSS | 13,617 | MLVMS_P03355_PLV919 |
| PAPEAAAK | 13,618 | PERV_Q4VFZ2_3mut |
| EAAAKPAPGSS | 13,619 | BAEVM_P10272_3mutA |
| GGSPAP | 13,620 | PERV_Q4VFZ2_3mutA_WS |
| GGSGGS | 13,621 | BAEVM_P10272_3mutA |
| PAPEAAAKGSS | 13,622 | KORV_Q9TTC1_3mut |
| PAPGSS | 13,623 | MLVMS_P03355_PLV919 |
| PAPAPAPAPAP | 13,624 | MLVAV_P03356_3mutA |
| GGG | | XMRV6_A1Z651_3mutA |
| GGGPAP | 13,626 | PERV_Q4VFZ2_3mutA_WS |
| GSSPAPEAAAK | 13,627 | KORV_Q9TTC1_3mutA |
| PAP | | BAEVM_P10272_3mutA |
| GGSPAP | 13,629 | BAEVM_P10272_3mutA |
| PAPEAAAKGGS | 13,630 | MLVMS_P03355_PLV919 |
| PAPGSSGGS | 13,631 | PERV_Q4VFZ2_3mutA_WS |
| PAPAPAPAPAPAP | 13,632 | PERV_Q4VFZ2_3mut |
| EAAAKEAAAKEAAAK | 13,633 | MLVCB_P08361_3mut |
| GGSGGSGGSGGSGGS | 13,634 | MLVMS_P03355_PLV919 |
| EAAAKPAPGGS | 13,635 | MLVMS_P03355_3mut |
| GGSGGS | 13,636 | MLVMS_P03355_PLV919 |
| EAAAKPAP | 13,637 | MLVMS_P03355_3mutA_WS |
| GGSEAAAK | 13,638 | XMRV6_A1Z651_3mutA |
| GGSGGG | 13,639 | KORV_Q9TTC1_3mut |
| GGSGGGEAAAK | 13,640 | PERV_Q4VFZ2_3mut |
| PAPEAAAKGGG | 13,641 | AVIRE_P03360 |
| PAPAP | 13,642 | PERV_Q4VFZ2_3mut |
| GSS | | KORV_Q9TTC1-Pro_3mutA |
| EAAAKGSSGGG | 13,644 | MLVAV_P03356_3mutA |
| GGSPAPGSS | 13,645 | MLVBM_Q7SVK7_3mutA_WS |
| PAPEAAAK | 13,646 | MLVAV_P03356_3mut |
| EAAAKGGSPAP | 13,647 | BAEVM_P10272_3mutA |
| PAPAPAPAP | 13,648 | WMSV_P03359_3mutA |
| PAPGGSEAAAK | 13,649 | MLVMS_P03355_3mut |
| GGSGGSGGSGGS | 13,650 | WMSV_P03359_3mut |
| GGGGGSGSS | 13,651 | XMRV6_A1Z651_3mut |
| PAPGGSGGG | 13,652 | KORV_Q9TTC1_3mutA |
| GGS | | MLVMS_P03355_3mut |
| EAAAK | 13,654 | WMSV_P03359_3mut |
| GGGEAAAKGSS | 13,655 | MLVBM_Q7SVK7_3mutA_WS |
| GGSPAPGSS | 13,656 | MLVCB_P08361_3mut |
| GGSEAAAKPAP | 13,657 | PERV_Q4VFZ2_3mut |
| GGGGSGGGGSGGGGSGGG GSGGGGS | 13,658 | MLVCB_P08361_3mutA |
| GGSGSS | 13,659 | BAEVM_P10272_3mutA |
| GGGEAAAKGSS | 13,660 | WMSV_P03359_3mutA |
| EAAAKGGSPAP | 13,661 | WMSV_P03359_3mut |
| GSSPAPEAAAK | 13,662 | MLVMS_P03355_3mut |
| GGSGGSGGSGGS | 13,663 | MLVMS_P03355_PLV919 |
| GSSPAPEAAAK | 13,664 | WMSV_P03359_3mut |
| GSSGSSGSSGSS | 13,665 | PERV_Q4VFZ2 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSGSSEAAAK | 13,666 | WMSV_P03359_3mutA |
| GGSGGG | 13,667 | MLVFF_P26809_3mut |
| GGSPAPGGG | 13,668 | MLVFF_P26809_3mut |
| GGSGGSGGS | 13,669 | BAEVM_P10272_3mutA |
| GGGGSSEAAAK | 13,670 | MLVBM_Q7SVK7_3mut |
| GGSPAPGSS | 13,671 | MLVMS_P03355_3mut |
| EAAAKPAPGSS | 13,672 | AVIRE_P03360_3mut |
| GGGGSSGGS | 13,673 | FLV_P10273_3mutA |
| GGSPAPEAAAK | 13,674 | PERV_Q4VFZ2_3mut |
| GGSEAAAK | 13,675 | MLVMS_P03355_3mutA_WS |
| GSSGSSGSSGSS | 13,676 | MLVCB_P08361_3mutA |
| EAAAKEAAAKEAAAKEAAAKEAAAK | 13,677 | MLVMS_P03355_PLV919 |
| GGGGG | 13,678 | PERV_Q4VFZ2_3mut |
| GGSEAAAKGSS | 13,679 | MLVCB_P08361_3mutA |
| GSSGGG | 13,680 | MLVBM_Q7SVK7_3mutA_WS |
| PAPGSSGGG | 13,681 | KORV_Q9TTC1-Pro_3mutA |
| GGSGGS | 13,682 | BAEVM_P10272_3mut |
| EAAAKGGGGGS | 13,683 | MLVBM_Q7SVK7_3mutA_WS |
| GGSGSSPAP | 13,684 | MLVCB_P08361_3mut |
| PAPGSSGGG | 13,685 | KORV_Q9TTC1 |
| PAPGGSGGG | 13,686 | MLVMS_P03355_3mut |
| GGGG | 13,687 | WMSV_P03359_3mutA |
| EAAAKGGSPAP | 13,688 | MLVCB_P08361_3mut |
| GSSGSS | 13,689 | FLV_P10273_3mutA |
| GGSEAAAKPAP | 13,690 | SFV3L_P27401_2mut |
| EAAAKGSSGGS | 13,691 | MLVAV_P03356_3mutA |
| AEAAAKEAAAKEAAAKEAAAKALEAEAAAKEAAAKEAAAKEAAAKA | 13,692 | MLVAV_P03356_3mutA |
| EAAAKGGSGSS | 13,693 | PERV_Q4VFZ2_3mutA_WS |
| GGGGG | 13,694 | MLVCB_P08361_3mut |
| GGGEAAAK | 13,695 | BAEVM_P10272_3mut |
| GGSGGSGGSGGS | 13,696 | MLVCB_P08361_3mut |
| EAAAKEAAAKEAAAKEAAAKEAAAKEAAAK | 13,697 | PERV_Q4VFZ2 |
| PAPAPAPAPAP | 13,698 | MLVMS_P03355_3mutA_WS |
| EAAAKEAAAK | 13,699 | XMRV6_A1Z651_3mut |
| GSSGGSEAAAK | 13,700 | PERV_Q4VFZ2_3mutA_WS |
| PAPGGSEAAAK | 13,701 | KORV_Q9TTC1-Pro_3mutA |
| EAAAKGGGPAP | 13,702 | MLVBM_Q7SVK7_3mutA_WS |
| PAPGGSGSS | 13,703 | PERV_Q4VFZ2 |
| SGSETPGTSESATPES | 13,704 | MLVMS_P03355_3mut |
| GGSGGS | 13,705 | MLVMS_P03355_PLV919 |
| EAAAKGGS | 13,706 | FLV_P10273_3mut |
| GGSPAPGSS | 13,707 | MLVMS_P03355_3mutA_WS |
| EAAAKEAAAKEAAAKEAAAK | 13,708 | FFV_O93209_2mut |
| GSSGGSGGG | 13,709 | MLVMS_P03355_3mutA_WS |
| PAPGSSEAAAK | 13,710 | WMSV_P03359_3mut |
| PAPAPAPAPAPAP | 13,711 | KORV_Q9TTC1_3mutA |
| GGGGSS | 13,712 | BAEVM_P10272_3mut |
| GGGGSEAAAKGGGGS | 13,713 | AVIRE_P03360_3mut |
| GSSPAPEAAAK | 13,714 | KORV_Q9TTC1-Pro_3mutA |
| PAPEAAAKGGG | 13,715 | MLVBM_Q7SVK7_3mut |
| EAAAKEAAAK | 13,716 | WMSV_P03359_3mut |
| EAAAK | 13,717 | SFV3L_P27401-Pro_2mutA |
| GSSGGSGGG | 13,718 | XMRV6_A1Z651_3mutA |
| GGGEAAAKPAP | 13,719 | WMSV_P03359_3mutA |
| GGSGGS | 13,720 | MLVFF_P26809_3mutA |
| EAAAKEAAAKEAAAKEAAAKEAAAKEAAAK | 13,721 | FOAMV_P14350_2mutA |
| GGGGG | 13,722 | MLVAV_P03356_3mutA |
| GSSGGSEAAAK | 13,723 | BAEVM_P10272_3mut |
| SGGSSGGSSGSETPGTSESATPESSGGSSGGSS | 13,724 | SFV1_P23074 |
| GGSGGGPAP | 13,725 | MLVCB_P08361_3mut |
| GGSGSS | 13,726 | PERV_Q4VFZ2_3mut |
| SGSETPGTSESATPES | 13,727 | MLVFF_P26809_3mut |
| EAAAKGGSPAP | 13,728 | MLVMS_P03355_3mut |
| PAPAP | 13,729 | PERV_Q4VFZ2_3mut |
| AEAAAKEAAAKEAAAKEAAAKALEAEAAAKEAAAKEAAAKEAAAKA | 13,730 | MLVBM_Q7SVK7_3mut |
| GGGGGS | 13,731 | BAEVM_P10272_3mutA |
| EAAAKEAAAK | 13,732 | AVIRE_P03360_3mut |
| GSSGGSEAAAK | 13,733 | PERV_Q4VFZ2_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGEAAAK | 13,734 | WMSV_P03359_3mut |
| GSSGGGEAAAK | 13,735 | AVIRE_P03360_3mutA |
| GGG | | XMRV6_A1Z651_3mut |
| GGGGSEAAAKGGGGS | 13,737 | BAEVM_P10272_3mut |
| GGGG | 13,738 | MLVMS_P03355_3mut |
| GGSGGS | 13,739 | MLVMS_P03355_3mutA_WS |
| GGSGGGGSS | 13,740 | MLVBM_Q7SVK7_3mutA_WS |
| GSSPAPGGS | 13,741 | PERV_Q4VFZ2_3mut |
| GSSPAPEAAAK | 13,742 | PERV_Q4VFZ2_3mutA_WS |
| EAAAKGGS | 13,743 | WMSV_P03359_3mut |
| GGSGGSGGSGGS | 13,744 | PERV_Q4VFZ2_3mut |
| GGGGSSEAAAK | 13,745 | KORV_Q9TTC1-Pro_3mut |
| PAPAPAPAPAPAP | 13,746 | MLVAV_P03356_3mut |
| EAAAKGSSGGG | 13,747 | MLVMS_P03355_PLV919 |
| GGGGG | 13,748 | MLVBM_Q7SVK7_3mutA_WS |
| AEAAAKEAAAKEAAAKEAAAKALEAEAAAKEAAAKEAAAKEAAAKA | 13,749 | FFV_O93209_2mutA |
| SGGSSGGSSGSETPGTSESATPESSGGSSGGSS | 13,750 | KORV_Q9TTC1-Pro_3mut |
| GGSPAPGGG | 13,751 | MLVMS_P03355_3mutA_WS |
| GGGEAAAKGGS | 13,752 | MLVMS_P03355_3mut |
| GGGEAAAK | 13,753 | PERV_Q4VFZ2_3mut |
| PAPEAAAKGGG | 13,754 | MLVMS_P03355_3mut |
| GSSGSSGSSGSSGSSGSS | 13,755 | BAEVM_P10272_3mutA |
| AEAAAKEAAAKEAAAKEAAAKALEAEAAAKEAAAKEAAAKEAAAKA | 13,756 | GALV_P21414_3mutA |
| EAAAKGGSPAP | 13,757 | FFV_O93209-Pro |
| EAAAKEAAAK | 13,758 | MLVFF_P26809_3mut |
| GGGGSGGGGSGGGGSGGGGSGGGGSGGGGS | 13,759 | PERV_Q4VFZ2_3mutA_WS |
| GGSGGSGGSGGS | 13,760 | MLVAV_P03356_3mutA |
| EAAAKEAAAKEAAAKEAAAKEAAAK | 13,761 | SFV3L_P27401_2mutA |
| GSSGSSGSSGSSGSSGSS | 13,762 | BAEVM_P10272_3mut |
| GGGGS | 13,763 | MLVMS_P03355_PLV919 |
| AEAAAKEAAAKEAAAKEAAAKALEAEAAAKEAAAKEAAAKEAAAKA | 13,764 | SFV1_P23074 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGGSGGGGS | 13,765 | KORV_Q9TTC1-Pro_3mutA |
| GGGGSGGGGS | 13,766 | MLVMS_P03355_3mut |
| GGSGSS | 13,767 | KORV_Q9TTC1_3mutA |
| GSSPAPGGG | 13,768 | PERV_Q4VFZ2_3mut |
| GSSGGSPAP | 13,769 | PERV_Q4VFZ2_3mutA_WS |
| PAPGGS | 13,770 | PERV_Q4VFZ2_3mutA_WS |
| GGSPAPEAAAK | 13,771 | FOAMV_P14350_2mutA |
| GGGPAPGGS | 13,772 | SFV3L_P27401_2mut |
| PAPGSSGGG | 13,773 | MLVCB_P08361_3mut |
| GSSGGGEAAAK | 13,774 | AVIRE_P03360_3mut |
| GSSGGG | 13,775 | XMRV6_A1Z651_3mut |
| GSSGSS | 13,776 | PERV_Q4VFZ2_3mut |
| GSSGGG | 13,777 | MLVAV_P03356_3mutA |
| PAPGGGGGS | 13,778 | PERV_Q4VFZ2_3mut |
| GSSEAAAK | 13,779 | MLVMS_P03355_3mut |
| PAPGGG | 13,780 | FLV_P10273_3mutA |
| GGGGSGGGGS | 13,781 | PERV_Q4VFZ2_3mut |
| GSSGGS | 13,782 | MLVMS_P03355_PLV919 |
| GGGGSGGGGS | 13,783 | SFV3L_P27401_2mut |
| EAAAKGGSGSS | 13,784 | FLV_P10273_3mutA |
| GSSEAAAKGGS | 13,785 | MLVMS_P03355_3mutA_WS |
| PAPGSSEAAAK | 13,786 | SFV3L_P27401_2mutA |
| GGGGSGGGGS | 13,787 | SFV3L_P27401-Pro_2mutA |
| PAPGSSEAAAK | 13,788 | PERV_Q4VFZ2_3mut |
| PAPGSSEAAAK | 13,789 | PERV_Q4VFZ2 |
| GGSPAPGGG | 13,790 | AVIRE_P03360_3mut |
| GGGGGS | 13,791 | PERV_Q4VFZ2_3mutA_WS |
| GGGGSSGGS | 13,792 | PERV_Q4VFZ2_3mut |
| PAPAPAPAP | 13,793 | AVIRE_P03360_3mutA |
| GGSGGS | 13,794 | WMSV_P03359_3mutA |
| GGGPAPGGS | 13,795 | PERV_Q4VFZ2_3mut |
| GGSGGSGGSGGSGGS | 13,796 | MLVMS_P03355_PLV919 |
| GGSGGG | 13,797 | PERV_Q4VFZ2_3mut |
| EAAAKEAAAK | 13,798 | SFV3L_P27401_2mut |
| PAPGSS | 13,799 | XMRV6_A1Z651_3mut |
| GSSEAAAK | 13,800 | MLVFF_P26809_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSPAPGGG | 13,801 | MLVMS_P03355_3mut |
| EAAAKGGG | 13,802 | WMSV_P03359_3mutA |
| GSSEAAAKGGS | 13,803 | PERV_Q4VFZ2_3mutA_WS |
| GSSGGSPAP | 13,804 | FFV_O93209 |
| GGGGGS | 13,805 | KORV_Q9TTC1-Pro_3mut |
| GSSGGG | 13,806 | MLVCB_P08361_3mut |
| GSSGSS | 13,807 | MLVCB_P08361_3mutA |
| GGSEAAAKPAP | 13,808 | BAEVM_P10272_3mut |
| EAAAKGGGGSS | 13,809 | MLVCB_P08361_3mut |
| EAAAKPAPGGS | 13,810 | KORV_Q9TTC1-Pro_3mutA |
| GSSGSSGSSGSSGSS | 13,811 | MLVAV_P03356_3mutA |
| GGGGSEAAAKGGGGS | 13,812 | PERV_Q4VFZ2_3mutA_WS |
| GGSGSS | 13,813 | KORV_Q9TTC1-Pro_3mut |
| GSS | | SFV3L_P27401-Pro_2mutA |
| PAPAP | 13,815 | BAEVM_P10272_3mut |
| EAAAKPAP | 13,816 | BAEVM_P10272 |
| EAAAKEAAAKEAAAKEAAAKEAAAK | 13,817 | KORV_Q9TTC1-Pro_3mut |
| GGGGGGG | 13,818 | PERV_Q4VFZ2_3mutA_WS |
| GGGGS | 13,819 | MLVMS_P03355_3mut |
| GSSGGG | 13,820 | FLV_P10273_3mutA |
| PAPAPAPAPAP | 13,821 | FLV_P10273_3mut |
| EAAAKEAAAKEAAAK | 13,822 | WMSV_P03359_3mutA |
| GSSGGS | 13,823 | MLVBM_Q7SVK7_3mutA_WS |
| EAAAKPAPGGG | 13,824 | MLVMS_P03355_3mut |
| GSSPAPGGS | 13,825 | WMSV_P03359_3mut |
| PAPGSSGGG | 13,826 | PERV_Q4VFZ2_3mutA_WS |
| GSSGGG | 13,827 | AVIRE_P03360_3mutA |
| PAPGGSGSS | 13,828 | MLVFF_P26809_3mut |
| PAPGSS | 13,829 | PERV_Q4VFZ2_3mut |
| GGGGGSGSS | 13,830 | WMSV_P03359_3mutA |
| EAAAKGGGGSS | 13,831 | MLVBM_Q7SVK7_3mutA_WS |
| GGGGGGG | 13,832 | BAEVM_P10272_3mut |
| PAPEAAAKGSS | 13,833 | MLVMS_P03355_3mut |
| GGSGGGEAAAK | 13,834 | MLVMS_P03355_PLV919 |
| EAAAKGGGGGS | 13,835 | MLVCB_P08361_3mut |
| PAPGGS | 13,836 | KORV_Q9TTC1-Pro_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGG | 13,837 | FLV_P10273_3mutA |
| EAAAKGGSGSS | 13,838 | MLVBM_Q7SVK7_3mutA_WS |
| GGGGSSGGS | 13,839 | MLVMS_P03355_3mutA_WS |
| GGGGGGGG | 13,840 | WMSV_P03359_3mut |
| GGSGSSGGG | 13,841 | MLVMS_P03355_PLV919 |
| GSSEAAAKGGS | 13,842 | KORV_Q9TTC1-Pro_3mutA |
| EAAAKPAPGSS | 13,843 | MLVCB_P08361_3mut |
| GGSPAPGSS | 13,844 | KORV_Q9TTC1_3mutA |
| PAPGSSGGG | 13,845 | BAEVM_P10272_3mut |
| EAAAKPAPGSS | 13,846 | WMSV_P03359_3mut |
| GGSPAPEAAAK | 13,847 | XMRV6_A1Z651_3mutA |
| GSSPAP | 13,848 | FLV_P10273_3mutA |
| GSS | | BAEVM_P10272_3mutA |
| EAAAKPAPGGS | 13,850 | FLV_P10273_3mutA |
| GGSGSSPAP | 13,851 | FLV_P10273_3mutA |
| PAPGSSGGS | 13,852 | MLVMS_P03355_3mut |
| GSAGSAAGSGEF | 13,853 | PERV_Q4VFZ2_3mutA_WS |
| GSSGGSEAAAK | 13,854 | KORV_Q9TTC1_3mutA |
| GSSGGS | 13,855 | MLVMS_P03355_3mutA_WS |
| EAAAKGGGGSEAAAK | 13,856 | SFV3L_P27401_2mut |
| GSSGGS | 13,857 | PERV_Q4VFZ2_3mutA_WS |
| GGSPAPEAAAK | 13,858 | FLV_P10273_3mut |
| GGSEAAAKGSS | 13,859 | PERV_Q4VFZ2_3mutA_WS |
| GSSPAPEAAAK | 13,860 | PERV_Q4VFZ2_3mutA_WS |
| GGSGSSGGG | 13,861 | PERV_Q4VFZ2_3mut |
| GGGG | 13,862 | AVIRE_P03360_3mutA |
| GGSEAAAKPAP | 13,863 | WMSV_P03359_3mut |
| GSSGGSPAP | 13,864 | MLVAV_P03356_3mutA |
| GSSGGSEAAAK | 13,865 | MLVMS_P03355_3mut |
| PAPEAAAKGGS | 13,866 | KORV_Q9TTC1-Pro_3mut |
| GGSPAP | 13,867 | PERV_Q4VFZ2_3mutA_WS |
| GGSEAAAK | 13,868 | MLVAV_P03356_3mutA |
| EAAAKGGGGSEAAAK | 13,869 | KORV_Q9TTC1-Pro_3mut |
| SGGSSGGSSGSETPGTSESATPESSGGSSGGSS | 13,870 | MLVMS_P03355_PLV919 |
| GSSEAAAK | 13,871 | KORV_Q9TTC1_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGG | | AVIRE_P03360 |
| GGSEAAAKGSS | 13,873 | MLVBM_Q7SVK7_3mut |
| GGSEAAAKGSS | 13,874 | MLVMS_P03355_3mut |
| GGSPAPEAAAK | 13,875 | MLVCB_P08361_3mut |
| GGSGGGEAAAK | 13,876 | MLVCB_P08361_3mut |
| GGSEAAAKPAP | 13,877 | MLVMS_P03355_3mutA_WS |
| EAAAKGGSGSS | 13,878 | KORV_Q9TTC1-Pro_3mut |
| GGGEAAAKGGS | 13,879 | MLVCB_P08361_3mut |
| EAAAKGGGGSEAAAK | 13,880 | FLV_P10273_3mutA |
| GGSPAP | 13,881 | MLVFF_P26809_3mut |
| GGGGSSGGS | 13,882 | XMRV6_A1Z651_3mutA |
| PAP | | MLVCB_P08361_3mut |
| GGS | | SFV3L_P27401-Pro_2mutA |
| GGGGSGGGGS | 13,885 | MLVMS_P03355_3mut |
| GGGEAAAKGGS | 13,886 | MLVAV_P03356_3mutA |
| GSSGSSGSSGSSGSSGSS | 13,887 | MLVMS_P03355_PLV919 |
| PAPGSS | 13,888 | MLVCB_P08361_3mut |
| GGSGGSGGS | 13,889 | MLVMS_P03355_PLV919 |
| PAPGGSGGG | 13,890 | FLV_P10273_3mutA |
| GGGGSGGGGSGGGGS | 13,891 | FLV_P10273_3mut |
| GGSGSSGGG | 13,892 | KORV_Q9TTC1-Pro_3mutA |
| GGSGGSGGS | 13,893 | GALV_P21414_3mutA |
| GGGEAAAKGGS | 13,894 | WMSV_P03359_3mut |
| SGSETPGTSESATPES | 13,895 | KORV_Q9TTC1_3mutA |
| EAAAKGGGGGS | 13,896 | KORV_Q9TTC1-Pro_3mut |
| EAAAKGSSPAP | 13,897 | BAEVM_P10272_3mut |
| GGGG | 13,898 | MLVCB_P08361_3mut |
| GGGGSGGGGSGGGGSGGG GSGGGGS | 13,899 | MLVBM_Q7SVK7_3mut |
| GSSGGSGGG | 13,900 | MLVMS_P03355_PLV919 |
| GGSGSS | 13,901 | MLVFF_P26809_3mut |
| EAAAKGGS | 13,902 | AVIRE_P03360_3mutA |
| GSSEAAAKGGS | 13,903 | MLVBM_Q7SVK7_3mutA_WS |
| EAAAKPAPGGG | 13,904 | WMSV_P03359_3mut |
| PAPGSSGGG | 13,905 | MLVCB_P08361_3mutA |
| GGGGSSEAAAK | 13,906 | KORV_Q9TTC1-Pro_3mutA |
| GSSEAAAKPAP | 13,907 | BAEVM_P10272_3mutA |
| PAPGGGEAAAK | 13,908 | MLVBM_Q7SVK7_3mutA_WS |
| GGSGGGEAAAK | 13,909 | MLVCB_P08361_3mutA |
| GGGGSGGGGSGGGGSGGG GSGGGGSGGGGS | 13,910 | FFV_O93209 |
| EAAAKGGGGGS | 13,911 | GALV_P21414_3mutA |
| GGSPAPGGG | 13,912 | MLVMS_P03355_3mut |
| GSSGSSGSS | 13,913 | FLV_P10273_3mutA |
| EAAAK | 13,914 | MLVBM_Q7SVK7_3mut |
| GGGGSSGGS | 13,915 | MLVMS_P03355_3mut |
| GGSGSSPAP | 13,916 | PERV_Q4VFZ2_3mut |
| EAAAKEAAAKEAAAKEAA AK | 13,917 | BAEVM_P10272_3mut |
| GGGPAPGSS | 13,918 | MLVMS_P03355_3mut |
| GSSPAPGGS | 13,919 | PERV_Q4VFZ2_3mutA_WS |
| PAPAP | 13,920 | FLV_P10273_3mutA |
| PAPAPAPAP | 13,921 | PERV_Q4VFZ2_3mut |
| GGGGGSEAAAK | 13,922 | GALV_P21414_3mutA |
| GGGGGSGSS | 13,923 | BAEVM_P10272_3mutA |
| GGGEAAAKGSS | 13,924 | KORV_Q9TTC1_3mutA |
| GGGGGSPAP | 13,925 | AVIRE_P03360_3mut |
| GGGGGSEAAAK | 13,926 | SFV3L_P27401_2mutA |
| GGS | | KORV_Q9TTC1_3mutA |
| GGGGGGG | 13,928 | PERV_Q4VFZ2_3mut |
| SGSETPGTSESATPES | 13,929 | SFV3L_P27401_2mutA |
| EAAAKGGSGGG | 13,930 | MLVMS_P03355_3mut |
| GGGGS | 13,931 | MLVFF_P26809_3mut |
| EAAAKGSSGGG | 13,932 | BAEVM_P10272_3mut |
| EAAAKPAPGGS | 13,933 | MLVF5_P26810_3mutA |
| SGGSSGGSSGSETPGTSE SATPESSGGSSGGSS | 13,934 | SFV3L_P27401_2mutA |
| GGSPAPGGG | 13,935 | WMSV_P03359_3mutA |
| GSAGSAAGSGEF | 13,936 | MLVFF_P26809_3mut |
| GGGGSSGGS | 13,937 | MLVMS_P03355_3mutA_WS |
| GGGGGGG | 13,938 | MLVCB_P08361_3mut |
| GSSEAAAK | 13,939 | WMSV_P03359_3mut |
| PAPGSS | 13,940 | FLV_P10273_3mutA |
| GSSGGG | 13,941 | PERV_Q4VFZ2_3mutA_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| PAPGGG | 13,942 | MLVFF_P26809_3mut |
| GGGGGSPAP | 13,943 | MLVMS_P03355_3mut |
| GGSEAAAK | 13,944 | XMRV6_A1Z651_3mut |
| GSSGGG | 13,945 | PERV_Q4VFZ2_3mut |
| GGSGGSGGSGGS | 13,946 | MLVMS_P03355_3mut |
| PAPAP | 13,947 | AVIRE_P03360_3mut |
| GGSEAAAK | 13,948 | PERV_Q4VFZ2_3mut |
| GGGGS | 13,949 | MLVMS_P03355_PLV919 |
| GGGG | 13,950 | BAEVM_P10272_3mutA |
| EAAAKGGGGSS | 13,951 | MLVCB_P08361_3mutA |
| EAAAKEAAAKEAAAK | 13,952 | GALV_P21414_3mutA |
| PAPGGGEAAAK | 13,953 | KORV_Q9TTC1 |
| EAAAKGGSPAP | 13,954 | MLVMS_P03355_3mut |
| GGSGSSEAAAK | 13,955 | MLVMS_P03355_3mut |
| GGSPAPEAAAK | 13,956 | FLV_P10273_3mutA |
| GGGGGGG | 13,957 | PERV_Q4VFZ2_3mut |
| EAAAKEAAAKEAAAKEAAAKEAAAKEAAAK | 13,958 | SFV1_P23074_2mutA |
| EAAAKGSSGGS | 13,959 | MLVMS_P03355_3mut |
| GSSEAAAKPAP | 13,960 | MLVFF_P26809_3mut |
| GGGGSS | 13,961 | FLV_P10273_3mutA |
| EAAAKGGSGGG | 13,962 | AVIRE_P03360_3mutA |
| GGSGGS | 13,963 | PERV_Q4VFZ2_3mutA_WS |
| GGGGGSPAP | 13,964 | AVIRE_P03360_3mutA |
| EAAAKEAAAKEAAAK | 13,965 | XMRV6_A1Z651_3mut |
| PAPEAAAKGGS | 13,966 | FLV_P10273_3mutA |
| GSSGGSEAAAK | 13,967 | MLVCB_P08361_3mut |
| EAAAKGGSGGG | 13,968 | MLVMS_P03355 |
| GGSGGGPAP | 13,969 | MLVMS_P03355_3mut |
| GGS | | XMRV6_A1Z651_3mut |
| GGSEAAAKPAP | 13,971 | MLVFF_P26809_3mut |
| EAAAKGGG | 13,972 | MLVMS_P03355_PLV919 |
| GSSGSSGSSGSS | 13,973 | WMSV_P03359_3mut |
| GGSGSSPAP | 13,974 | PERV_Q4VFZ2_3mut |
| GGGEAAAK | 13,975 | MLVMS_P03355_3mutA_WS |
| GSSPAPGGS | 13,976 | KORV_Q9TTC1-Pro_3mutA |
| GSSEAAAKGGG | 13,977 | SFV3L_P27401_2mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKPAPGGS | 13,978 | MLVCB_P08361_3mut |
| GGSGGGEAAAK | 13,979 | PERV_Q4VFZ2 |
| GGSGSS | 13,980 | MLVCB_P08361_3mut |
| GGSGGGEAAAK | 13,981 | MLVBM_Q7SVK7_3mutA_WS |
| GGSGGSGGSGGSGGSGGS | 13,982 | FLV_P10273_3mut |
| PAPEAAAKGSS | 13,983 | MLVMS_P03355_3mut |
| EAAAKGSSGGS | 13,984 | WMSV_P03359_3mutA |
| GGSGSSEAAAK | 13,985 | MLVCB_P08361_3mut |
| GGSGSSEAAAK | 13,986 | KORV_Q9TTC1_3mutA |
| GSSGGSGGG | 13,987 | MLVMS_P03355_PLV919 |
| EAAAKGGSGGG | 13,988 | SFV3L_P27401-Pro_2mutA |
| GGSGGS | 13,989 | AVIRE_P03360_3mutA |
| GSAGSAAGSGEF | 13,990 | MLVMS_P03355_PLV919 |
| GGSGSS | 13,991 | GALV_P21414_3mutA |
| GGGG | 13,992 | MLVFF_P26809_3mutA |
| GGGGSGGGGSGGGGSGGGGS | 13,993 | WMSV_P03359_3mut |
| SGSETPGTSESATPES | 13,994 | BAEVM_P10272_3mut |
| EAAAKEAAAKEAAAKEAAAK | 13,995 | FOAMV_P14350_2mutA |
| GGGEAAAKGGS | 13,996 | FLV_P10273_3mutA |
| GSSGGSEAAAK | 13,997 | MLVFF_P26809_3mut |
| EAAAKGGGGSS | 13,998 | MLVAV_P03356_3mut |
| PAPGGSEAAAK | 13,999 | KORV_Q9TTC1-Pro_3mut |
| EAAAK | 14,000 | XMRV6_A1Z651_3mut |
| GSSGSSGSSGSSGSSGSS | 14,001 | PERV_Q4VFZ2_3mut |
| GGGG | 14,002 | MLVCB_P08361_3mutA |
| GSSGSS | 14,003 | WMSV_P03359_3mutA |
| GSSGGSPAP | 14,004 | AVIRE_P03360_3mut |
| GGSGGSGGS | 14,005 | MLVCB_P08361_3mut |
| EAAAKGGGPAP | 14,006 | FLV_P10273_3mutA |
| GGGGSGGGGS | 14,007 | MLVCB_P08361_3mut |
| GGSEAAAKGSS | 14,008 | PERV_Q4VFZ2_3mutA_WS |
| EAAAKEAAAKEAAAKEAAAKEAAAKEAAAK | 14,009 | SFV3L_P27401_2mutA |
| GGSGSSEAAAK | 14,010 | PERV_Q4VFZ2_3mutA_WS |
| EAAAKEAAAKEAAAKEAAAK | 14,011 | SFV3L_P27401-Pro_2mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSEAAAKGGS | 14,012 | FLV_P10273_3mutA |
| GGSGSS | 14,013 | PERV_Q4VFZ2 |
| GGSGSSEAAAK | 14,014 | SFV3L_P27401-Pro_2mutA |
| GSSGSSGSS | 14,015 | XMRV6_A1Z651_3mutA |
| EAAAKGSSPAP | 14,016 | KORV_Q9TTC1_3mutA |
| EAAAKPAP | 14,017 | FLV_P10273_3mutA |
| GGSGSSEAAAK | 14,018 | KORV_Q9TTC1-Pro_3mut |
| GGGGSGGGGSGGGGSGGG GSGGGGSGGGGS | 14,019 | KORV_Q9TTC1_3mutA |
| GGGGSGGGGSGGGGS | 14,020 | KORV_Q9TTC1-Pro_3mutA |
| GGGGGGG | 14,021 | FLV_P10273_3mut |
| EAAAKGSS | 14,022 | WMSV_P03359_3mut |
| EAAAKGGGPAP | 14,023 | MLVCB_P08361_3mut |
| GSSGSS | 14,024 | MLVBM_Q7SVK7_3mutA_WS |
| EAAAKGGGGGS | 14,025 | MLVFF_P26809_3mut |
| GGSGGGEAAAK | 14,026 | FLV_P10273_3mutA |
| PAPGSS | 14,027 | MLVFF_P26809_3mutA |
| PAPGSS | 14,028 | BAEVM_P10272_3mutA |
| GGSPAPGSS | 14,029 | AVIRE_P03360_3mut |
| GGGGSSEAAAK | 14,030 | MLVMS_P03355_3mut |
| GSSGGGGGS | 14,031 | FFV_O93209-Pro |
| EAAAKGSSPAP | 14,032 | PERV_Q4VFZ2_3mut |
| GSSPAPGGS | 14,033 | PERV_Q4VFZ2_3mut |
| GGGGGG | 14,034 | BAEVM_P10272_3mut |
| EAAAKGGGGSS | 14,035 | PERV_Q4VFZ2_3mutA_WS |
| PAPGGSEAAAK | 14,036 | KORV_Q9TTC1_3mutA |
| SGGSSGGSSGSETPGTSE SATPESSGGSSGGSS | 14,037 | MLVMS_P03355_3mutA_WS |
| GSSGSSGSSGSS | 14,038 | MLVMS_P03355_3mut |
| EAAAKGSSGGG | 14,039 | MLVMS_P03355_PLV919 |
| GGSEAAAKPAP | 14,040 | AVIRE_P03360_3mutA |
| GSSGSSGSSGSSGSS | 14,041 | WMSV_P03359_3mutA |
| GGGEAAAKPAP | 14,042 | FLV_P10273_3mutA |
| PAPGSSGGG | 14,043 | KORV_Q9TTC1_3mutA |
| GSSGSS | 14,044 | MLVMS_P03355_3mutA_WS |
| PAPEAAAK | 14,045 | BAEVM_P10272_3mut |
| GGGPAPGSS | 14,046 | PERV_Q4VFZ2 |
| GSSGGSPAP | 14,047 | MLVFF_P26809_3mut |
| GGGGSS | 14,048 | SFV3L_P27401_2mut |
| PAPEAAAKGSS | 14,049 | SFV3L_P27401_2mut |
| GGSGGGPAP | 14,050 | XMRV6_A1Z651_3mutA |
| PAPGGS | 14,051 | BAEVM_P10272_3mutA |
| EAAAKGGGGGS | 14,052 | AVIRE_P03360_3mut |
| GSSGGSPAP | 14,053 | KORV_Q9TTC1-Pro_3mutA |
| GSSGGGGGS | 14,054 | WMSV_P03359_3mut |
| GGGEAAAKGGS | 14,055 | AVIRE_P03360_3mut |
| GGGEAAAKGSS | 14,056 | BAEVM_P10272_3mut |
| PAPEAAAKGSS | 14,057 | MLVAV_P03356_3mutA |
| GSSGSSGSSGSSGSS | 14,058 | MLVCB_P08361_3mut |
| GGSPAPGSS | 14,059 | FLV_P10273_3mutA |
| EAAAKGSSPAP | 14,060 | BAEVM_P10272_3mutA |
| GGSGGSGGSGGSGGSGGS | 14,061 | PERV_Q4VFZ2 |
| GGGGSSEAAAK | 14,062 | FLV_P10273_3mutA |
| GGGGSSPAP | 14,063 | FFV_O93209 |
| GSSGGSPAP | 14,064 | MLVMS_P03355_3mut |
| GGGPAPGSS | 14,065 | MLVMS_P03355_PLV919 |
| PAPGSSGGS | 14,066 | PERV_Q4VFZ2_3mut |
| GGGGGSPAP | 14,067 | MLVFF_P26809_3mut |
| SGSETPGTSESATPES | 14,068 | MLVMS_P03355_3mutA_WS |
| GSSGSSGSSGSSGSS | 14,069 | KORV_Q9TTC1_3mutA |
| GSSPAPGGG | 14,070 | WMSV_P03359_3mut |
| PAPAPAPAPAPAP | 14,071 | SFV3L_P27401_2mutA |
| GGGPAPGGS | 14,072 | MLVMS_P03355_3mut |
| PAPGGSEAAAK | 14,073 | WMSV_P03359_3mut |
| GGGGSSEAAAK | 14,074 | FFV_O93209-Pro |
| GGSPAPGGG | 14,075 | FLV_P10273_3mutA |
| GSSPAPEAAAK | 14,076 | AVIRE_P03360_3mut |
| GGGEAAAK | 14,077 | FLV_P10273_3mutA |
| PAPEAAAKGGG | 14,078 | MLVCB_P08361_3mut |
| GGSPAPGGG | 14,079 | MLVCB_P08361_3mut |
| GGSGGGGSS | 14,080 | BAEVM_P10272_3mutA |
| GSSPAPEAAAK | 14,081 | MLVCB_P08361_3mut |
| GGSPAPGGG | 14,082 | KORV_Q9TTC1-Pro_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| PAPGGSGSS | 14,083 | KORV_Q9TTC1_3mutA |
| GSSPAP | 14,084 | KORV_Q9TTC1-Pro_3mutA |
| SGSETPGTSESATPES | 14,085 | MLVMS_P03355 |
| GSSGSSGSS | 14,086 | MLVAV_P03356_3mutA |
| PAPGSSGGS | 14,087 | PERV_Q4VFZ2_3mutA_WS |
| PAPGGS | 14,088 | KORV_Q9TTC1-Pro_3mutA |
| PAPEAAAKGGG | 14,089 | SFV3L_P27401-Pro_2mutA |
| GGSGGSGGS | 14,090 | BAEVM_P10272_3mut |
| PAPGGS | 14,091 | MLVFF_P26809_3mut |
| GSSGGSPAP | 14,092 | MLVMS_P03355_PLV919 |
| GSSGGGGGS | 14,093 | FLV_P10273_3mutA |
| GGGGGSPAP | 14,094 | KORV_Q9TTC1-Pro_3mut |
| EAAAKPAPGSS | 14,095 | SFV3L_P27401-Pro_2mutA |
| EAAAKGGSPAP | 14,096 | KORV_Q9TTC1-Pro |
| GGGPAPEAAAK | 14,097 | MLVMS_P03355_PLV919 |
| GGSEAAAKGSS | 14,098 | MLVMS_P03355 |
| PAPEAAAKGSS | 14,099 | KORV_Q9TTC1_3mutA |
| PAPEAAAKGGS | 14,100 | WMSV_P03359_3mutA |
| GSSGGG | 14,101 | PERV_Q4VFZ2_3mutA_WS |
| EAAAKGGGGSS | 14,102 | MLVMS_P03355_PLV919 |
| EAAAKGGSPAP | 14,103 | AVIRE_P03360_3mutA |
| GGGGSSGGS | 14,104 | MLVMS_P03355_PLV919 |
| PAPEAAAKGSS | 14,105 | PERV_Q4VFZ2_3mutA_WS |
| EAAAKGGGGGS | 14,106 | BAEVM_P10272_3mut |
| GSSGGGGGS | 14,107 | MLVMS_P03355_3mut |
| PAPAPAPAP | 14,108 | KORV_Q9TTC1_3mutA |
| GGSGGSGGSGGS | 14,109 | MLVAV_P03356_3mut |
| PAPAPAPAP | 14,110 | SFV3L_P27401_2mut |
| GSSEAAAKPAP | 14,111 | MLVMS_P03355_3mut |
| GGSGGGEAAAK | 14,112 | SFV3L_P27401_2mutA |
| GSSGGSGGG | 14,113 | MLVMS_P03355_3mutA_WS |
| GGGGGSPAP | 14,114 | MLVCB_P08361_3mutA |
| GGGEAAAKGSS | 14,115 | XMRV6_A1Z651_3mutA |
| GGGGSSPAP | 14,116 | BAEVM_P10272_3mut |
| GGSGGG | 14,117 | PERV_Q4VFZ2_3mut |
| GGGGSS | 14,118 | MLVBM_Q7SVK7_3mutA_WS |
| EAAAKGSSGGS | 14,119 | PERV_Q4VFZ2_3mutA_WS |
| GSSGGGGGS | 14,120 | PERV_Q4VFZ2 |
| EAAAKGSSGGS | 14,121 | PERV_Q4VFZ2_3mut |
| EAAAKEAAAK | 14,122 | MLVAV_P03356_3mut |
| GSSGGGEAAAK | 14,123 | MLVAV_P03356_3mut |
| GSSPAPGGG | 14,124 | XMRV6_A1Z651_3mut |
| GGGGSGGGGSGGGGS | 14,125 | PERV_Q4VFZ2_3mut |
| EAAAKEAAAKEAAAKEAAAK | 14,126 | KORV_Q9TTC1_3mutA |
| EAAAKGGSGSS | 14,127 | MLVBM_Q7SVK7_3mut |
| PAPEAAAK | 14,128 | BLVJ_P03361 |
| GSSGGG | 14,129 | FFV_O93209-Pro |
| GGSGGGEAAAK | 14,130 | KORV_Q9TTC1-Pro_3mutA |
| EAAAK | 14,131 | FLV_P10273_3mutA |
| GGGGSSPAP | 14,132 | MLVMS_P03355_3mut |
| GSS | | SFV3L_P27401-Pro_2mut |
| PAPEAAAKGSS | 14,134 | BAEVM_P10272_3mut |
| GGGGGSPAP | 14,135 | PERV_Q4VFZ2_3mut |
| GSSGSSGSS | 14,136 | BAEVM_P10272_3mutA |
| GGGGSGGGGSGGGGSGGGGS | 14,137 | SFV1_P23074_2mut |
| GGGGSSEAAAK | 14,138 | SFV3L_P27401_2mutA |
| GGGGSGGGGSGGGGSGGGGS | 14,139 | FOAMV_P14350-Pro_2mut |
| PAPGSSEAAAK | 14,140 | MLVBM_Q7SVK7_3mutA_WS |
| GGGGGSGSS | 14,141 | MLVFF_P26809_3mutA |
| GGSEAAAKGGG | 14,142 | MLVBM_Q7SVK7_3mut |
| PAPGSSGGG | 14,143 | PERV_Q4VFZ2 |
| GGS | | PERV_Q4VFZ2_3mutA_WS |
| EAAAKGGSGSS | 14,145 | FLV_P10273_3mut |
| GGGEAAAK | 14,146 | WMSV_P03359_3mutA |
| GGSEAAAKPAP | 14,147 | MLVBM_Q7SVK7_3mut |
| SGSETPGTSESATPES | 14,148 | FOAMV_P14350-Pro_2mutA |
| EAAAKPAPGGS | 14,149 | AVIRE_P03360_3mut |
| EAAAKGGGGGS | 14,150 | KORV_Q9TTC1-Pro_3mutA |
| GGGGS | 14,151 | PERV_Q4VFZ2_3mut |
| GGSEAAAKGSS | 14,152 | MLVFF_P26809_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSEAAAKGGG | 14,153 | AVIRE_P03360 |
| GGSGGSGGSGGSGGSGGS | 14,154 | SFV3L_P27401_2mut |
| GGSEAAAKGSS | 14,155 | SFV3L_P27401-Pro_2mutA |
| GGGEAAAKPAP | 14,156 | MLVCB_P08361_3mut |
| GGSEAAAK | 14,157 | MLVMS_P03355_PLV919 |
| GGSPAPGSS | 14,158 | KORV_Q9TTC1-Pro_3mutA |
| GSSPAPEAAAK | 14,159 | WMSV_P03359_3mutA |
| GGSGSS | 14,160 | KORV_Q9TTC1-Pro_3mutA |
| PAPGGGGGS | 14,161 | AVIRE_P03360_3mut |
| PAPEAAAKGSS | 14,162 | FFV_O93209-Pro |
| GGSGGGEAAAK | 14,163 | WMSV_P03359_3mut |
| PAPGGG | 14,164 | MLVMS_P03355_3mut |
| EAAAKGGG | 14,165 | FLV_P10273_3mutA |
| GSSGSSGSSGSS | 14,166 | MLVCB_P08361_3mut |
| EAAAKGGSGGG | 14,167 | FFV_O93209 |
| GSSPAPGGS | 14,168 | PERV_Q4VFZ2_3mutA_WS |
| GSSPAPGGS | 14,169 | MLVCB_P08361_3mut |
| GGGPAP | 14,170 | WMSV_P03359_3mutA |
| GGGPAP | 14,171 | KORV_Q9TTC1_3mutA |
| GGSPAPGSS | 14,172 | KORV_Q9TTC1-Pro_3mut |
| PAPAP | 14,173 | MLVMS_P03355_3mut |
| GGGGGGG | 14,174 | MLVMS_P03355_3mut |
| GGGGG | 14,175 | KORV_Q9TTC1-Pro_3mut |
| GSAGSAAGSGEF | 14,176 | FOAMV_P14350_2mutA |
| PAPAP | 14,177 | KORV_Q9TTC1-Pro_3mutA |
| GGSEAAAKGGG | 14,178 | SFV3L_P27401-Pro_2mutA |
| PAPAP | 14,179 | WMSV_P03359_3mut |
| GGGGSGGGGSGGGGS | 14,180 | SFV3L_P27401_2mut |
| PAPGGS | 14,181 | KORV_Q9TTC1_3mutA |
| GGGEAAAKPAP | 14,182 | FLV_P10273_3mut |
| GGGGGS | 14,183 | MLVAV_P03356_3mutA |
| GSSEAAAKGGG | 14,184 | WMSV_P03359_3mut |
| EAAAKGGGGSS | 14,185 | GALV_P21414_3mutA |
| GSSGGS | 14,186 | MLVAV_P03356_3mutA |
| GSSGGG | 14,187 | MLVBM_Q7SVK7_3mut |
| PAPAPAP | 14,188 | SFV3L_P27401-Pro_2mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGG | 14,189 | KORV_Q9TTC1_3mutA |
| EAAAKPAPGGS | 14,190 | MLVFF_P26809_3mut |
| GGGGSGGGGS | 14,191 | XMRV6_A1Z651_3mut |
| EAAAKGGG | 14,192 | MLVCB_P08361_3mut |
| GGGGSSPAP | 14,193 | KORV_Q9TTC1_3mutA |
| GSSEAAAKGGG | 14,194 | KORV_Q9TTC1-Pro_3mutA |
| GGGGG | 14,195 | BLVJ_P03361_2mutB |
| GGGEAAAKGSS | 14,196 | FFV_O93209-Pro |
| GSSGSSGSS | 14,197 | BAEVM_P10272_3mut |
| GSSGGSPAP | 14,198 | PERV_Q4VFZ2_3mut |
| EAAAKGGS | 14,199 | KORV_Q9TTC1_3mut |
| GGSPAPEAAAK | 14,200 | AVIRE_P03360_3mut |
| GGSEAAAK | 14,201 | WMSV_P03359_3mut |
| GSSGGS | 14,202 | KORV_Q9TTC1-Pro_3mutA |
| GGGPAPEAAAK | 14,203 | KORV_Q9TTC1_3mutA |
| PAPGSS | 14,204 | WMSV_P03359_3mutA |
| GGSEAAAKGSS | 14,205 | FLV_P10273_3mutA |
| EAAAKEAAAKEAAAKEAAAKEAAAK | 14,206 | SFV3L_P27401 |
| GSSEAAAKGGG | 14,207 | SFV3L_P27401-Pro_2mutA |
| GGGGSEAAAKGGGGS | 14,208 | KORV_Q9TTC1-Pro_3mutA |
| GGSGGSGGS | 14,209 | WMSV_P03359_3mut |
| GGGGGSGSS | 14,210 | KORV_Q9TTC1-Pro |
| GGGGSGGGGSGGGGSGGGGS | 14,211 | MLVMS_P03355_3mut |
| EAAAKGGG | 14,212 | PERV_Q4VFZ2 |
| GGSEAAAKGGG | 14,213 | KORV_Q9TTC1-Pro_3mut |
| GSSGGSGGG | 14,214 | PERV_Q4VFZ2_3mutA_WS |
| GGGGGS | 14,215 | PERV_Q4VFZ2_3mut |
| GSAGSAAGSGEF | 14,216 | PERV_Q4VFZ2 |
| PAPEAAAKGSS | 14,217 | BAEVM_P10272_3mutA |
| GSSPAPGGG | 14,218 | MLVCB_P08361_3mut |
| GGGGSSPAP | 14,219 | KORV_Q9TTC1-Pro_3mutA |
| PAPGGSGGG | 14,220 | MLVFF_P26809_3mut |
| GSSPAP | 14,221 | KORV_Q9TTC1_3mutA |
| PAPGSS | 14,222 | SFV3L_P27401-Pro_2mut |
| GGSGGGGSS | 14,223 | MLVMS_P03355_PLV919 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSGGS | 14,224 | WMSV_P03359_3mutA |
| EAAAKGGGGGS | 14,225 | PERV_Q4VFZ2 |
| GGGGG | 14,226 | KORV_Q9TTC1_3mutA |
| EAAAKGSS | 14,227 | MLVMS_P03355_PLV919 |
| EAAAKEAAAKEAAAKEAAAKEAAAK | 14,228 | FLV_P10273_3mut |
| EAAAKEAAAKEAAAKEAAAK | 14,229 | SFV3L_P27401-Pro_2mut |
| GSAGSAAGSGEF | 14,230 | SFV3L_P27401_2mutA |
| GGGPAPGGS | 14,231 | FLV_P10273_3mutA |
| GGSEAAAKGGG | 14,232 | MLVCB_P08361_3mut |
| PAPGGGEAAAK | 14,233 | BAEVM_P10272_3mut |
| EAAAKPAPGSS | 14,234 | FOAMV_P14350_2mut |
| GGSEAAAK | 14,235 | KORV_Q9TTC1_3mutA |
| GGSGSS | 14,236 | AVIRE_P03360 |
| GGSPAPEAAAK | 14,237 | MLVMS_P03355_PLV919 |
| GGGGS | 14,238 | XMRV6_A1Z651_3mut |
| GGSPAPGGG | 14,239 | XMRV6_A1Z651_3mut |
| EAAAKPAPGGS | 14,240 | PERV_Q4VFZ2 |
| GSSPAP | 14,241 | BAEVM_P10272_3mut |
| GGSGSSGGG | 14,242 | FLV_P10273_3mutA |
| PAPGGG | 14,243 | PERV_Q4VFZ2_3mutA_WS |
| GSSGGSEAAAK | 14,244 | MLVBM_Q7SVK7_3mut |
| GGSEAAAK | 14,245 | MLVMS_P03355_3mut |
| GGGPAPGGS | 14,246 | MLVFF_P26809_3mut |
| GSAGSAAGSGEF | 14,247 | MLVBM_Q7SVK7_3mutA_WS |
| EAAAKPAPGGS | 14,248 | SFVCP_Q87040 |
| PAPGGG | 14,249 | PERV_Q4VFZ2_3mutA_WS |
| GSSPAPEAAAK | 14,250 | MLVBM_Q7SVK7 |
| PAPEAAAK | 14,251 | MLVBM_Q7SVK7_3mut |
| PAPGGGGGS | 14,252 | AVIRE_P03360_3mutA |
| GGSEAAAKPAP | 14,253 | MLVBM_Q7SVK7_3mut |
| EAAAKGSS | 14,254 | WMSV_P03359_3mutA |
| GGGEAAAK | 14,255 | MLVFF_P26809_3mutA |
| EAAAKEAAAKEAAAK | 14,256 | MLVMS_P03355_3mut |
| PAPEAAAKGGG | 14,257 | BAEVM_P10272_3mut |
| PAPAPAP | 14,258 | MLVCB_P08361_3mut |
| EAAAKPAPGGS | 14,259 | BAEVM_P10272_3mut |
| GGGGSGGGGS | 14,260 | FLV_P10273_3mut |
| GGGGSEAAAKGGGGS | 14,261 | KORV_Q9TTC1_3mut |
| EAAAK | 14,262 | FLV_P10273_3mut |
| PAPAPAP | 14,263 | WMSV_P03359_3mut |
| GGGGSEAAAKGGGGS | 14,264 | FFV_O93209-Pro |
| GGSPAPEAAAK | 14,265 | MLVMS_P03355_3mut |
| GGSGSSGGG | 14,266 | XMRV6_A1Z651_3mut |
| GGSPAPGSS | 14,267 | PERV_Q4VFZ2_3mut |
| SGGSSGGSSGSETPGTSESATPESSGGSSGGSS | 14,268 | SFV3L_P27401-Pro_2mutA |
| EAAAKGGGPAP | 14,269 | BAEVM_P10272_3mutA |
| GSSGGSEAAAK | 14,270 | MLVMS_P03355_3mutA_WS |
| SGSETPGTSESATPES | 14,271 | PERV_Q4VFZ2_3mutA_WS |
| EAAAKEAAAKEAAAKEAAAKEAAAK | 14,272 | KORV_Q9TTC1-Pro_3mutA |
| GSSGSSGSS | 14,273 | KORV_Q9TTC1_3mutA |
| GSSPAPGGG | 14,274 | SFV3L_P27401-Pro_2mutA |
| GSSGGGEAAAK | 14,275 | KORV_Q9TTC1_3mutA |
| GGSGGGGSS | 14,276 | PERV_Q4VFZ2_3mutA_WS |
| GSSGGGEAAAK | 14,277 | MLVCB_P08361_3mut |
| GSSEAAAKGGG | 14,278 | MLVCB_P08361_3mut |
| GGSGGGGSS | 14,279 | KORV_Q9TTC1_3mutA |
| GGSGSSPAP | 14,280 | PERV_Q4VFZ2_3mutA_WS |
| GSSPAP | 14,281 | MLVMS_P03355_3mut |
| GGGGSSEAAAK | 14,282 | AVIRE_P03360 |
| GGS | | WMSV_P03359_3mut |
| EAAAKEAAAK | 14,284 | PERV_Q4VFZ2_3mut |
| PAPAPAPAP | 14,285 | MLVAV_P03356_3mut |
| GGSEAAAKGGG | 14,286 | KORV_Q9TTC1_3mutA |
| PAPGGG | 14,287 | MLVAV_P03356_3mut |
| EAAAKGSS | 14,288 | BAEVM_P10272_3mut |
| GGGGSGGGGS | 14,289 | WMSV_P03359_3mutA |
| GGSGGSGGS | 14,290 | SFV3L_P27401_2mut |
| EAAAK | 14,291 | MLVCB_P08361_3mut |
| GGGGSSGGS | 14,292 | WMSV_P03359_3mutA |
| GGGPAPEAAAK | 14,293 | MLVAV_P03356_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKEAAAKEAAAK | 14,294 | FFV_O93209 |
| GSSEAAAKGGG | 14,295 | MLVBM_Q7SVK7_3mut |
| GGGPAPGGS | 14,296 | FLV_P10273_3mut |
| GGSEAAAKGGG | 14,297 | WMSV_P03359_3mut |
| EAAAKGGGGGS | 14,298 | XMRV6_A1Z651_3mutA |
| EAAAKGGSGGG | 14,299 | FLV_P10273_3mutA |
| GGSEAAAKGGG | 14,300 | SFV3L_P27401_2mutA |
| GGGGS | 14,301 | PERV_Q4VFZ2_3mutA_WS |
| GSSGGS | 14,302 | MLVMS_P03355_3mut |
| GSSGSS | 14,303 | MLVAV_P03356_3mutA |
| GGSPAPGGG | 14,304 | MLVBM_Q7SVK7_3mutA_WS |
| GSSGGGGGS | 14,305 | MLVF5_P26810_3mut |
| PAPAPAPAP | 14,306 | MLVCB_P08361_3mut |
| PAPAP | 14,307 | PERV_Q4VFZ2_3mutA_WS |
| PAPGSSGGS | 14,308 | KORV_Q9TTC1_3mut |
| PAPGSSGGG | 14,309 | PERV_Q4VFZ2_3mut |
| GGGEAAAK | 14,310 | MLVMS_P03355_PLV919 |
| GGSGGSGGSGGSGGS | 14,311 | SFV3L_P27401-Pro_2mutA |
| GGSGGG | 14,312 | FLV_P10273_3mut |
| PAPEAAAKGGG | 14,313 | MLVFF_P26809_3mut |
| PAP | | PERV_Q4VFZ2_3mutA_WS |
| PAPGGSGSS | 14,315 | FFV_O93209_2mut |
| EAAAKEAAAKEAAAKEAAAKEAAAKEAAAK | 14,316 | FFV_O93209-Pro_2mut |
| GSSGSSGSSGSS | 14,317 | FFV_O93209-Pro |
| GSSGSSGSSGSSGSS | 14,318 | FLV_P10273_3mutA |
| GGGEAAAKPAP | 14,319 | PERV_Q4VFZ2 |
| PAPGSSGGG | 14,320 | SFV3L_P27401_2mut |
| PAPGGSGSS | 14,321 | KORV_Q9TTC1-Pro_3mut |
| PAPAPAPAPAP | 14,322 | GALV_P21414_3mutA |
| GGSGGGEAAAK | 14,323 | PERV_Q4VFZ2_3mut |
| GSSPAP | 14,324 | MLVCB_P08361_3mut |
| EAAAKPAP | 14,325 | MLVF5_P26810_3mut |
| GGGGSGGGGSGGGGSGGGGS | 14,326 | MLVBM_Q7SVK7_3mut |
| GGSGGG | 14,327 | WMSV_P03359_3mut |
| GGSGGSGGS | 14,328 | KORV_Q9TTC1_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGGGGGG | 14,329 | MLVFF_P26809_3mut |
| GGGGSS | 14,330 | MLVAV_P03356_3mut |
| GSSGGGGGS | 14,331 | SFV3L_P27401_2mut |
| EAAAKEAAAKEAAAKEAAAKEAAAKEAAAK | 14,332 | GALV_P21414_3mutA |
| GSSGSSGSS | 14,333 | PERV_Q4VFZ2_3mut |
| GSSPAPGGS | 14,334 | MLVFF_P26809_3mut |
| PAPAPAP | 14,335 | AVIRE_P03360_3mutA |
| EAAAKEAAAKEAAAKEAAAK | 14,336 | WMSV_P03359_3mutA |
| PAPAPAPAP | 14,337 | SFV3L_P27401_2mutA |
| GGGGSS | 14,338 | MLVAV_P03356_3mutA |
| GSSGSSGSSGSSGSS | 14,339 | SFV3L_P27401_2mutA |
| PAPGGS | 14,340 | WMSV_P03359_3mutA |
| GSSEAAAKGGG | 14,341 | PERV_Q4VFZ2 |
| GSSGGSPAP | 14,342 | MLVMS_P03355_PLV919 |
| GSSGSSGSSGSSGSSGSS | 14,343 | SFV3L_P27401_2mutA |
| GGGSGSSGGG | 14,344 | MLVCB_P08361_3mut |
| GGGPAPGSS | 14,345 | SFV3L_P27401-Pro_2mutA |
| GSSEAAAKGGS | 14,346 | WMSV_P03359_3mut |
| GSSEAAAKGGG | 14,347 | MLVAV_P03356_3mut |
| GGSGGGPAP | 14,348 | FFV_O93209-Pro |
| GSSGSS | 14,349 | PERV_Q4VFZ2_3mut |
| PAPGGGGGS | 14,350 | GALV_P21414_3mutA |
| EAAAKPAPGGS | 14,351 | MLVAV_P03356_3mut |
| GSSGSS | 14,352 | MLVMS_P03355_3mut |
| EAAAKPAPGGS | 14,353 | FFV_O93209-Pro |
| GGGPAPEAAAK | 14,354 | MLVMS_P03355_3mutA_WS |
| GSSEAAAKGGG | 14,355 | MLVBM_Q7SVK7_3mut |
| GGGEAAAKGGS | 14,356 | BAEVM_P10272_3mut |
| GSSGSS | 14,357 | KORV_Q9TTC1-Pro_3mutA |
| EAAAKEAAAKEAAAK | 14,358 | SFV1_P23074 |
| PAPGSSGGS | 14,359 | KORV_Q9TTC1-Pro_3mut |
| PAPAPAPAPAP | 14,360 | MLVMS_P03355 |
| GSSEAAAK | 14,361 | SFV3L_P27401_2mut |
| PAP | | PERV_Q4VFZ2_3mut |
| GGSEAAAKGGG | 14,363 | MLVBM_Q7SVK7_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSGGGPAP | 14,364 | MLVBM_Q7SVK7_3mutA_WS |
| GSSGSS | 14,365 | MLVMS_P03355_3mut |
| GGSEAAAK | 14,366 | MLVMS_P03355 |
| GSSEAAAKGGS | 14,367 | MLVMS_P03355_PLV919 |
| PAPGGGGGS | 14,368 | MLVFF_P26809_3mut |
| GSSGGG | 14,369 | PERV_Q4VFZ2_3mut |
| GSSGGS | 14,370 | PERV_Q4VFZ2_3mutA_WS |
| PAPGGG | 14,371 | BAEVM_P10272_3mut |
| PAPGSSGGG | 14,372 | MLVBM_Q7SVK7_3mut |
| GGSEAAAK | 14,373 | SFV3L_P27401_2mut |
| GSSPAPEAAAK | 14,374 | SFV3L_P27401-Pro_2mut |
| GSSGGSPAP | 14,375 | BAEVM_P10272_3mut |
| GGSPAPGSS | 14,376 | PERV_Q4VFZ2_3mutA_WS |
| GGSGGSGGS | 14,377 | PERV_Q4VFZ2 |
| GGSGGGPAP | 14,378 | FLV_P10273_3mut |
| GGGPAPEAAAK | 14,379 | SFV3L_P27401_2mutA |
| GGGGS | 14,380 | FLV_P10273_3mutA |
| GSSGGSGGG | 14,381 | XMRV6_A1Z651_3mut |
| EAAAKGGGGSS | 14,382 | PERV_Q4VFZ2 |
| GGSGSSGGG | 14,383 | SFV3L_P27401-Pro_2mutA |
| GGSGGSGGS | 14,384 | MLVFF_P26809_3mut |
| GGGPAPEAAAK | 14,385 | FLV_P10273_3mut |
| GSSGGGEAAAK | 14,386 | MLVMS_P03355_3mut |
| GGG | | SFV3L_P27401_2mut |
| GSAGSAAGSGEF | 14,388 | WMSV_P03359_3mut |
| GSSGGGPAP | 14,389 | MLVMS_P03355_PLV919 |
| GGGGSS | 14,390 | KORV_Q9TTC1-Pro_3mut |
| GGGGSSEAAAK | 14,391 | KORV_Q9TTC1 |
| PAPGGSGGG | 14,392 | SFV3L_P27401_2mut |
| GSSGSSGSSGSSGSS | 14,393 | FFV_O93209 |
| GSSGGSPAP | 14,394 | MLVMS_P03355_3mut |
| GGSEAAAK | 14,395 | KORV_Q9TTC1-Pro_3mutA |
| GGGGGGGGS | 14,396 | BAEVM_P10272_3mut |
| GSSEAAAKGGG | 14,397 | AVIRE_P03360_3mut |
| EAAAKPAPGGG | 14,398 | FLV_P10273_3mut |
| EAAAKGGSPAP | 14,399 | SFV3L_P27401-Pro_2mutA |
| GSSEAAAKPAP | 14,400 | MLVBM_Q7SVK7_3mut |
| GGGPAPGGS | 14,401 | MLVCB_P08361_3mut |
| GGG | | SFV3L_P27401_2mutA |
| EAAAKGGGGSEAAAK | 14,403 | SFV3L_P27401_2mutA |
| GGSGSSGGG | 14,404 | MLVBM_Q7SVK7_3mut |
| GSAGSAAGSGEF | 14,405 | BAEVM_P10272_3mut |
| GGGEAAAK | 14,406 | FOAMV_P14350_2mutA |
| PAPEAAAKGGS | 14,407 | WMSV_P03359_3mut |
| PAPAPAPAPAPAP | 14,408 | MLVF5_P26810_3mutA |
| GGSGGGGSS | 14,409 | FLV_P10273_3mutA |
| PAPGSSGGS | 14,410 | BAEVM_P10272_3mut |
| PAPEAAAK | 14,411 | WMSV_P03359_3mutA |
| GSSGSSGSSGSSGSSGSS | 14,412 | FFV_O93209-Pro_2mut |
| GGGGGSGSS | 14,413 | FFV_O93209-Pro |
| GGGGGGGG | 14,414 | SFV3L_P27401-Pro_2mutA |
| GGGGGG | 14,415 | FLV_P10273_3mut |
| GSSGGSGGG | 14,416 | MLVAV_P03356_3mutA |
| GGGGSS | 14,417 | SFV3L_P27401-Pro_2mutA |
| GGSGGGPAP | 14,418 | FOAMV_P14350_2mut |
| GSSGSS | 14,419 | AVIRE_P03360_3mutA |
| EAAAKEAAAKEAAAKEAAAKEAAAK | 14,420 | SFV3L_P27401-Pro_2mutA |
| EAAAKEAAAK | 14,421 | BAEVM_P10272_3mut |
| GSSPAPEAAAK | 14,422 | GALV_P21414_3mutA |
| GGSEAAAKPAP | 14,423 | SFV3L_P27401_2mutA |
| GGSGGGEAAAK | 14,424 | SFV3L_P27401-Pro_2mutA |
| EAAAKGSSPAP | 14,425 | FOAMV_P14350_2mut |
| GGSGSSEAAAK | 14,426 | SFV3L_P27401_2mut |
| GGG | | PERV_Q4VFZ2 |
| GGGGGSGSS | 14,428 | FOAMV_P14350_2mut |
| GGSGGGEAAAK | 14,429 | KORV_Q9TTC1-Pro_3mut |
| GSSGGSGGG | 14,430 | AVIRE_P03360_3mutA |
| EAAAKPAPGGG | 14,431 | SFV3L_P27401_2mutA |
| PAPGGSGGG | 14,432 | KORV_Q9TTC1-Pro_3mut |
| PAPAPAP | 14,433 | WMSV_P03359_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSEAAAKPAP | 14,434 | SFV1_P23074 |
| SGGSSGGSSGSETPGTSE SATPESSGGSSGGSS | 14,435 | SRV2_P51517 |
| GSSGGSGGG | 14,436 | PERV_Q4VFZ2_3mutA_WS |
| GSSGSSGSSGSSGSSGSS | 14,437 | FFV_O93209 |
| GSSGGGPAP | 14,438 | WMSV_P03359_3mut |
| PAPAPAPAPAPAP | 14,439 | MLVBM_Q7SVK7_3mut |
| GGGGGSPAP | 14,440 | KORV_Q9TTC1-Pro_3mutA |
| PAPGSS | 14,441 | MLVBM_Q7SVK7_3mutA_WS |
| PAPEAAAKGGS | 14,442 | SFV3L_P27401-Pro_2mut |
| GGGGSSPAP | 14,443 | MLVMS_P03355_3mut |
| GGSEAAAK | 14,444 | FFV_O93209-Pro |
| EAAAKPAPGGS | 14,445 | AVIRE_P03360_3mutA |
| PAPGSS | 14,446 | WMSV_P03359_3mut |
| PAPGSSGGG | 14,447 | SFV3L_P27401-Pro_2mutA |
| EAAAKEAAAKEAAAK | 14,448 | SFV3L_P27401_2mut |
| GGS | | MLVRD_P11227_3mut |
| GGGGS | 14,450 | KORV_Q9TTC1-Pro_3mut |
| GGSGGGGSS | 14,451 | KORV_Q9TTC1 |
| GGSGGG | 14,452 | MLVMS_P03355_3mutA_WS |
| GGGEAAAKPAP | 14,453 | BAEVM_P10272_3mut |
| EAAAKEAAAKEAAAKEAA AKEAAAK | 14,454 | FLV_P10273 |
| PAPGGSGGG | 14,455 | KORV_Q9TTC1-Pro_3mutA |
| GSSGSSGSSGSSGSSGSS | 14,456 | HTL1L_P0C211 |
| GGGEAAAKPAP | 14,457 | WMSV_P03359 |
| GSSGGSPAP | 14,458 | FFV_O93209-Pro |
| PAPAPAPAPAP | 14,459 | SFV3L_P27401-Pro_2mutA |
| GSSGGSEAAAK | 14,460 | SFV3L_P27401_2mutA |
| GGSPAPGSS | 14,461 | SFV3L_P27401_2mut |
| GGSGGSGGS | 14,462 | KORV_Q9TTC1-Pro_3mut |
| PAPEAAAKGSS | 14,463 | KORV_Q9TTC1-Pro_3mut |
| EAAAKGGS | 14,464 | KORV_Q9TTC1_3mutA |
| EAAAKGGGGSEAAAK | 14,465 | SFV3L_P27401-Pro_2mut |
| GGGGSSPAP | 14,466 | FFV_O93209-Pro |
| EAAAK | 14,467 | SFV3L_P27401_2mut |
| EAAAKGGGGSS | 14,468 | BAEVM_P10272_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGGGSEAAAK | 14,469 | MLVBM_Q7SVK7_3mut |
| GGGG | 14,470 | PERV_Q4VFZ2 |
| GGGGGSEAAAK | 14,471 | FLV_P10273_3mut |
| EAAAKGGGPAP | 14,472 | KORV_Q9TTC1-Pro |
| GGGGSGGGGSGGGGSGGG GS | 14,473 | FFV_O93209_2mutA |
| GSSGGSGGG | 14,474 | PERV_Q4VFZ2_3mut |
| GGGGSGGGGSGGGGS | 14,475 | GALV_P21414_3mutA |
| GGSGGGEAAAK | 14,476 | AVIRE_P03360_3mutA |
| PAPEAAAKGGG | 14,477 | SFV3L_P27401_2mut |
| GGGGSGGGGS | 14,478 | AVIRE_P03360 |
| GSSGGGEAAAK | 14,479 | SFV3L_P27401_2mutA |
| GGGGG | 14,480 | AVIRE_P03360_3mutA |
| GGSGSS | 14,481 | KORV_Q9TTC1_3mut |
| PAPAPAPAPAPAP | 14,482 | FOAMV_P14350_2mut |
| GGSEAAAKPAP | 14,483 | KORV_Q9TTC1-Pro_3mut |
| GGGGGG | 14,484 | PERV_Q4VFZ2_3mut |
| GSSGGGEAAAK | 14,485 | MLVBM_Q7SVK7 |
| SGGSSGGSSGSETPGTSE SATPESSGGSSGGSS | 14,486 | MLVAV_P03356 |
| GGSPAPGSS | 14,487 | BAEVM_P10272_3mut |
| GGGGSSPAP | 14,488 | BAEVM_P10272 |
| GGGGSEAAAKGGGGS | 14,489 | SFV3L_P27401_2mut |
| GGGGGGGG | 14,490 | GALV_P21414_3mutA |
| PAPAP | 14,491 | MLVAV_P03356_3mut |
| GGGEAAAK | 14,492 | PERV_Q4VFZ2_3mutA_WS |
| GSSPAPGGG | 14,493 | FFV_O93209_2mut |
| GGSGGSGGSGGSGGS | 14,494 | BAEVM_P10272 |
| GGGGGS | 14,495 | MLVF5_P26810_3mutA |
| PAPGGGGSS | 14,496 | FLV_P10273_3mutA |
| GGGEAAAK | 14,497 | MLVBM_Q7SVK7_3mut |
| PAPEAAAKGGG | 14,498 | WMSV_P03359_3mut |
| GSSEAAAK | 14,499 | MLVBM_Q7SVK7_3mut |
| EAAAKEAAAK | 14,500 | AVIRE_P03360 |
| EAAAKGGGGGS | 14,501 | MLVBM_Q7SVK7_3mut |
| GGGEAAAKGGS | 14,502 | SFV3L_P27401-Pro_2mutA |
| PAPAPAPAPAP | 14,503 | MLVF5_P26810_3mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| PAPGSSEAAAK | 14,504 | SFV3L_P27401-Pro_2mutA |
| EAAAKEAAAKEAAAK | 14,505 | BAEVM_P10272_3mutA |
| GGSPAPGSS | 14,506 | MLVMS_P03355 |
| PAPGSSGGS | 14,507 | FLV_P10273_3mutA |
| EAAAKEAAAKEAAAKEAAAK | 14,508 | FOAMV_P14350-Pro_2mut |
| EAAAKGGG | 14,509 | KORV_Q9TTC1_3mutA |
| EAAAKGGSGGG | 14,510 | MLVBM_Q7SVK7_3mut |
| GGGGGS | 14,511 | KORV_Q9TTC1-Pro_3mutA |
| PAPGGSGGG | 14,512 | WMSV_P03359_3mut |
| GGGPAPGGS | 14,513 | KORV_Q9TTC1_3mutA |
| GSS | | FFV_O93209 |
| GGSGGSGGS | 14,515 | PERV_Q4VFZ2_3mut |
| GGGGS | 14,516 | GALV_P21414_3mutA |
| GGGG | 14,517 | MLVF5_P26810_3mut |
| GGSEAAAKPAP | 14,518 | FFV_O93209-Pro_2mut |
| PAPAPAPAP | 14,519 | FFV_O93209-Pro |
| PAP | | MLVF5_P26810_3mut |
| EAAAKEAAAKEAAAK | 14,521 | FFV_O93209_2mut |
| EAAAKGSS | 14,522 | MLVCB_P08361_3mut |
| EAAAKGGG | 14,523 | MLVBM_Q7SVK7_3mut |
| PAPEAAAKGGG | 14,524 | FFV_O93209_2mut |
| GSSGGGEAAAK | 14,525 | SFV1_P23074-Pro_2mut |
| PAPGGGEAAAK | 14,526 | GALV_P21414_3mutA |
| GGGGSGGGGSGGGGSGGGGS | 14,527 | FOAMV_P14350-Pro_2mutA |
| GSSGGG | 14,528 | FOAMV_P14350_2mut |
| GGGGSGGGGSGGGGSGGGGS | 14,529 | SFV3L_P27401_2mutA |
| GGSGSS | 14,530 | AVIRE_P03360_3mut |
| GGSGSSEAAAK | 14,531 | MMTVB_P03365_WS |
| PAPAPAP | 14,532 | MLVAV_P03356_3mutA |
| GSSGGSPAP | 14,533 | SFV3L_P27401-Pro_2mut |
| GGSPAP | 14,534 | AVIRE_P03360 |
| GGSGGGPAP | 14,535 | FFV_O93209 |
| GSSEAAAK | 14,536 | PERV_Q4VFZ2 |
| GSSGGGPAP | 14,537 | PERV_Q4VFZ2_3mutA_WS |
| GGGGSSEAAAK | 14,538 | KORV_Q9TTC1_3mutA |
| GGSEAAAKPAP | 14,539 | SFVCP_Q87040 |
| GGSGGGPAP | 14,540 | FOAMV_P14350_2mutA |
| GGGGSGGGGSGGGGSGGGGS | 14,541 | BLVJ_P03361_2mutB |
| GGGGSSPAP | 14,542 | SFV3L_P27401_2mutA |
| EAAAKGGS | 14,543 | MLVF5_P26810_3mut |
| GGSEAAAKGSS | 14,544 | MLVCB_P08361_3mut |
| GGGGSSEAAAK | 14,545 | SFV3L_P27401_2mut |
| EAAAKGGSGGG | 14,546 | FOAMV_P14350_2mut |
| GGSGGS | 14,547 | FLV_P10273_3mut |
| EAAAKGGG | 14,548 | FFV_O93209-Pro |
| GSSGSSGSSGSSGSS | 14,549 | SFV3L_P27401 |
| GSSGGGPAP | 14,550 | PERV_Q4VFZ2_3mutA_WS |
| PAPGGSEAAAK | 14,551 | SFV3L_P27401-Pro_2mutA |
| GGSPAP | 14,552 | KORV_Q9TTC1 |
| EAAAKPAPGSS | 14,553 | KORV_Q9TTC1_3mutA |
| SGSETPGTSESATPES | 14,554 | SFV1_P23074 |
| GSSPAP | 14,555 | SFV3L_P27401-Pro_2mutA |
| GSSPAPGGG | 14,556 | SFV3L_P27401_2mut |
| GGGEAAAKGSS | 14,557 | SFV1_P23074_2mut |
| GGGPAPGGS | 14,558 | BAEVM_P10272_3mut |
| EAAAKGGG | 14,559 | KORV_Q9TTC1-Pro_3mutA |
| GSSGGG | 14,560 | SFV3L_P27401-Pro_2mut |
| GGSPAPEAAAK | 14,561 | BAEVM_P10272_3mut |
| EAAAKGSSPAP | 14,562 | FFV_O93209 |
| EAAAKGGGGSEAAAK | 14,563 | SFV3L_P27401-Pro_2mutA |
| GSSGSSGSSGSSGSS | 14,564 | SFV1_P23074_2mut |
| EAAAKGGSPAP | 14,565 | FOAMV_P14350_2mut |
| GGSGGS | 14,566 | KORV_Q9TTC1-Pro_3mutA |
| EAAAKGSSGGS | 14,567 | GALV_P21414 |
| GSSGGGPAP | 14,568 | MLVAV_P03356 |
| PAPEAAAKGGS | 14,569 | FOAMV_P14350_2mut |
| EAAAKPAPGGG | 14,570 | AVIRE_P03360_3mut |
| GGSPAP | 14,571 | SFV3L_P27401_2mutA |
| GGGGSGGGGS | 14,572 | SFV3L_P27401_2mutA |
| GGGGSS | 14,573 | AVIRE_P03360_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSPAPGGG | 14,574 | SFV3L_P27401-Pro_2mutA |
| EAAAKPAPGSS | 14,575 | SFV3L_P27401 |
| EAAAKPAP | 14,576 | FOAMV_P14350-Pro_2mut |
| PAPEAAAKGSS | 14,577 | PERV_Q4VFZ2_3mutA_WS |
| EAAAKGGSGSS | 14,578 | SFV3L_P27401_2mutA |
| GGGEAAAKGSS | 14,579 | GALV_P21414_3mutA |
| GGGGSEAAAKGGGGS | 14,580 | PERV_Q4VFZ2_3mut |
| PAPGGSGSS | 14,581 | FFV_O93209-Pro_2mutA |
| GGSEAAAKPAP | 14,582 | GALV_P21414_3mutA |
| GGSGGSGGSGGSGGS | 14,583 | FFV_O93209-Pro |
| GSSGGSEAAAK | 14,584 | SFV3L_P27401-Pro_2mut |
| GGS | | GALV_P21414_3mutA |
| PAPGGSEAAAK | 14,586 | MLVMS_P03355 |
| PAPEAAAKGGS | 14,587 | BAEVM_P10272_3mutA |
| GGSGSSPAP | 14,588 | SFV3L_P27401-Pro_2mutA |
| GSSPAP | 14,589 | WMSV_P03359_3mut |
| GGGEAAAK | 14,590 | MMTVB_P03365 |
| GGGGSS | 14,591 | PERV_Q4VFZ2_3mut |
| GGSPAPGSS | 14,592 | SFV3L_P27401-Pro_2mut |
| PAPGGS | 14,593 | MLVBM_Q7SVK7_3mut |
| EAAAKGSSPAP | 14,594 | MLVBM_Q7SVK7_3mut |
| GGGGSSGGS | 14,595 | PERV_Q4VFZ2_3mut |
| PAPAPAPAPAPAP | 14,596 | SFV1_P23074 |
| GGSEAAAKGGG | 14,597 | SFV3L_P27401-Pro_2mut |
| GGSGGS | 14,598 | SFV1_P23074_2mut |
| GSSGGGGGS | 14,599 | MLVF5_P26810_3mutA |
| EAAAKGGGPAP | 14,600 | SFV3L_P27401 |
| EAAAKEAAAKEAAAKEAAAK | 14,601 | FOAMV_P14350-Pro_2mutA |
| GGGPAPGSS | 14,602 | SFV3L_P27401_2mutA |
| GGGGSGGGGSGGGGSGGGGS | 14,603 | SFV3L_P27401_2mut |
| EAAAKEAAAKEAAAKEAAAK | 14,604 | MMTVB_P03365_WS |
| PAPGSSGGS | 14,605 | KORV_Q9TTC1-Pro_3mutA |
| PAPGSSEAAAK | 14,606 | FOAMV_P14350-Pro_2mut |
| GSSPAPEAAAK | 14,607 | BAEVM_P10272_3mut |
| EAAAKGGGGSEAAAK | 14,608 | FFV_O93209-Pro |
| GGSPAP | 14,609 | PERV_Q4VFZ2 |
| GGSGSSEAAAK | 14,610 | XMRV6_A1Z651_3mut |
| GGSEAAAKGGG | 14,611 | GALV_P21414_3mutA |
| PAPGGGGSS | 14,612 | AVIRE_P03360_3mutA |
| GGSGGSGGSGGS | 14,613 | PERV_Q4VFZ2 |
| GGGGSSGGS | 14,614 | PERV_Q4VFZ2_3mutA_WS |
| SGGSSGGSSGSETPGTSESATPESSGGSSGGSS | 14,615 | BAEVM_P10272_3mutA |
| GGGPAP | 14,616 | MLVAV_P03356_3mut |
| GGGGSGGGGSGGGGSGGGGS | 14,617 | FFV_O93209_2mut |
| GSSEAAAK | 14,618 | FFV_O93209 |
| GGSPAPEAAAK | 14,619 | FOAMV_P14350_2mut |
| GGGGGSEAAAK | 14,620 | FOAMV_P14350_2mut |
| GSSPAPGGS | 14,621 | MLVBM_Q7SVK7_3mut |
| GSS | | SFVCP_Q87040_2mut |
| EAAAKPAP | 14,623 | FOAMV_P14350-Pro |
| EAAAKGGG | 14,624 | SFV3L_P27401_2mut |
| GGGEAAAK | 14,625 | AVIRE_P03360_3mutA |
| PAPGSSGGG | 14,626 | WMSV_P03359_3mut |
| EAAAKGGSPAP | 14,627 | SFV3L_P27401 |
| GSSGGSGGG | 14,628 | SFV3L_P27401-Pro_2mutA |
| GSSGGGEAAAK | 14,629 | GALV_P21414_3mutA |
| GGGPAPGSS | 14,630 | MLVBM_Q7SVK7_3mutA_WS |
| PAPGGGEAAAK | 14,631 | FFV_O93209-Pro_2mut |
| GSSGSSGSSGSS | 14,632 | SFV1_P23074_2mut |
| GGSEAAAK | 14,633 | PERV_Q4VFZ2_3mutA_WS |
| GGGEAAAKPAP | 14,634 | SFV3L_P27401_2mut |
| EAAAKGGGPAP | 14,635 | SFV3L_P27401_2mut |
| GGGGSSPAP | 14,636 | FLV_P10273_3mut |
| EAAAKPAPGSS | 14,637 | FFV_O93209_2mut |
| GGGGSSPAP | 14,638 | SFV3L_P27401_2mut |
| GSSGSS | 14,639 | KORV_Q9TTC1_3mutA |
| GGGGSGGGGSGGGGGGGSGGGGS | 14,640 | BLVJ_P03361_2mut |
| GGGGSSGGS | 14,641 | GALV_P21414_3mutA |
| EAAAKGGSGSS | 14,642 | FFV_O93209-Pro |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKPAP | 14,643 | PERV_Q4VFZ2 |
| GSSGGGEAAAK | 14,644 | MLVBM_Q7SVK7_3mut |
| PAPGGSGGG | 14,645 | BAEVM_P10272 |
| EAAAKGGGPAP | 14,646 | MLVF5_P26810 |
| GSSGSSGSS | 14,647 | MLVBM_Q7SVK7_3mut |
| GSSGGS | 14,648 | AVIRE_P03360_3mutA |
| GGSEAAAKGGG | 14,649 | FOAMV_P14350_2mut |
| EAAAKGGS | 14,650 | MLVF5_P26810_3mutA |
| GGSGSSGGG | 14,651 | WMSV_P03359_3mut |
| EAAAK | 14,652 | SFV1_P23074_2mut |
| GSSGGSPAP | 14,653 | SFV3L_P27401-Pro_2mutA |
| GGGGSSGGS | 14,654 | KORV_Q9TTC1_3mut |
| PAPGGSGGG | 14,655 | FFV_O93209-Pro_2mut |
| GGGPAPGGS | 14,656 | SFV3L_P27401_2mutA |
| GSSPAPEAAAK | 14,657 | FLV_P10273_3mut |
| GGSGSSPAP | 14,658 | SFV3L_P27401_2mut |
| GSSEAAAKGGS | 14,659 | SFV3L_P27401_2mut |
| PAPGGG | 14,660 | SFV3L_P27401_2mutA |
| SGSETPGTSESATPES | 14,661 | KORV_Q9TTC1-Pro_3mut |
| GGGGS | 14,662 | SFV1_P23074-Pro_2mutA |
| GSSGGGEAAAK | 14,663 | WMSV_P03359 |
| EAAAKGGGGSEAAAK | 14,664 | MLVF5_P26810_3mutA |
| GSSEAAAKPAP | 14,665 | FFV_O93209 |
| GGGGGG | 14,666 | SFV1_P23074_2mutA |
| EAAAKEAAAKEAAAK | 14,667 | MMTVB_P03365-Pro |
| EAAAKPAPGSS | 14,668 | MLVBM_Q7SVK7_3mut |
| GGSGSSEAAAK | 14,669 | SFV3L_P27401_2mutA |
| GGSEAAAK | 14,670 | MLVMS_P03355_3mut |
| GGSPAPEAAAK | 14,671 | SFV3L_P27401_2mut |
| GGGPAPGSS | 14,672 | SFV1_P23074 |
| GGGGGSEAAAK | 14,673 | MLVBM_Q7SVK7_3mutA_WS |
| EAAAKPAPGSS | 14,674 | KORV_Q9TTC1-Pro |
| GSSGSSGSSGSS | 14,675 | SFV3L_P27401_2mut |
| EAAAKPAP | 14,676 | SFV3L_P27401_2mut |
| GGGEAAAK | 14,677 | PERV_Q4VFZ2_3mut |
| GGSGGS | 14,678 | SFV3L_P27401_2mutA |
| EAAAKGSSGGS | 14,679 | MMTVB_P03365 |
| SGSETPGTSESATPES | 14,680 | SFV3L_P27401 |
| EAAAKGSSGGG | 14,681 | PERV_Q4VFZ2 |
| EAAAKEAAAKEAAAKEAAAKEAAAKEAAAK | 14,682 | MMTVB_P03365 |
| GGSGGGPAP | 14,683 | KORV_Q9TTC1_3mutA |
| PAPAPAPAP | 14,684 | SFV3L_P27401 |
| GGGEAAAKGGS | 14,685 | SFV1_P23074_2mut |
| GSSGGSGGG | 14,686 | PERV_Q4VFZ2_3mut |
| PAPEAAAKGGS | 14,687 | FOAMV_P14350_2mutA |
| GGGEAAAKGSS | 14,688 | SFV3L_P27401_2mut |
| GGGGSGGGGSGGGGSGGGGS | 14,689 | MLVBM_Q7SVK7 |
| PAPGSSGGG | 14,690 | FLV_P10273 |
| GGSGSSGGG | 14,691 | FFV_O93209 |
| EAAAKPAPGSS | 14,692 | MLVBM_Q7SVK7 |
| GSSEAAAKGGG | 14,693 | SFV3L_P27401_2mutA |
| GGSGGSGGSGGSGGS | 14,694 | MLVF5_P26810 |
| GGSEAAAKPAP | 14,695 | SFV3L_P27401-Pro_2mutA |
| EAAAKGGSPAP | 14,696 | SFV3L_P27401_2mutA |
| EAAAKGGGGGS | 14,697 | SFV3L_P27401_2mut |
| GSSPAPEAAAK | 14,698 | SFV3L_P27401_2mutA |
| PAPAP | 14,699 | MLVBM_Q7SVK7_3mut |
| PAPGGSEAAAK | 14,700 | KORV_Q9TTC1-Pro |
| GGSGSS | 14,701 | MLVF5_P26810_3mutA |
| GGSEAAAKPAP | 14,702 | FFV_O93209_2mut |
| GSS | | MLVMS_P03355 |
| SGGSSGGSSGSETPGTSESATPESSGGSSGGSS | 14,704 | SFV3L_P27401-Pro |
| PAPGGGEAAAK | 14,705 | SFV3L_P27401_2mut |
| PAPGGGGGS | 14,706 | SFV3L_P27401-Pro_2mut |
| PAPGGSGSS | 14,707 | BAEVM_P10272_3mut |
| GSSGGGEAAAK | 14,708 | FFV_O93209 |
| GGSEAAAKPAP | 14,709 | SFV1_P23074_2mut |
| GGGGG | 14,710 | FLV_P10273_3mut |
| GGGEAAAKGSS | 14,711 | SFV3L_P27401 |
| GSSGSSGSSGSSGSS | 14,712 | SFV1_P23074-Pro |
| SGSETPGTSESATPES | 14,713 | AVIRE_P03360 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| PAPGSSGGG | 14,714 | MLVBM_Q7SVK7_3mut |
| GGGGSSPAP | 14,715 | HTL3P_Q4U0X6_2mut |
| GGGEAAAK | 14,716 | SFV1_P23074 |
| GGSGGG | 14,717 | AVIRE_P03360 |
| EAAAKGSSGGG | 14,718 | SFV3L_P27401_2mutA |
| GSSPAPEAAAK | 14,719 | FOAMV_P14350-Pro_2mutA |
| GGGPAPGSS | 14,720 | WMSV_P03359 |
| EAAAKGSSGGG | 14,721 | MLVMS_P03355 |
| GGGGGSEAAAK | 14,722 | MLVMS_P03355 |
| EAAAKPAPGGS | 14,723 | SFV3L_P27401 |
| EAAAKGSSPAP | 14,724 | SFV3L_P27401 |
| GGGGGGG | 14,725 | FOAMV_P14350_2mutA |
| EAAAKEAAAKEAAAK | 14,726 | SFV3L_P27401 |
| GSSPAPGGS | 14,727 | FFV_O93209_2mutA |
| GGGGSSEAAAK | 14,728 | SFV3L_P27401-Pro_2mutA |
| GGSEAAAKGSS | 14,729 | GALV_P21414_3mutA |
| GGSEAAAKGSS | 14,730 | BAEVM_P10272_3mutA |
| EAAAKPAPGGG | 14,731 | MLVCB_P08361 |
| GSSGSSGSSGSSGSSGSS | 14,732 | SFV1_P23074-Pro |
| GGGGSEAAAKGGGGS | 14,733 | FOAMV_P14350_2mut |
| GSSPAPGGS | 14,734 | MLVMS_P03355_PLV919 |
| GGGGGGGGS | 14,735 | FFV_O93209-Pro |
| GSSGGSPAP | 14,736 | KORV_Q9TTC1_3mutA |
| GGSGGS | 14,737 | GALV_P21414_3mutA |
| PAPGSSEAAAK | 14,738 | WMSV_P03359 |
| PAPGGGGSS | 14,739 | MMTVB_P03365-Pro |
| GGGGSSGGS | 14,740 | PERV_Q4VFZ2_3mutA_WS |
| GGGGSGGGGS | 14,741 | FFV_O93209_2mut |
| GGGGGGGGSGGGGSGGGGS | 14,742 | XMRV6_A1Z651 |
| GGSGSSEAAAK | 14,743 | SFV1_P23074_2mut |
| GGSGGGGSS | 14,744 | GALV_P21414_3mutA |
| GGSEAAAKPAP | 14,745 | MLVBM_Q7SVK7 |
| EAAAKGGSPAP | 14,746 | SFV1_P23074_2mutA |
| PAPAPAPAP | 14,747 | FFV_O93209 |
| GSSGGSPAP | 14,748 | MMTVB_P03365-Pro |
| GGGGGSPAP | 14,749 | KORV_Q9TTC1_3mutA |
| EAAAKGGGPAP | 14,750 | PERV_Q4VFZ2 |
| GSSGGSPAP | 14,751 | BAEVM_P10272 |
| GGGGG | 14,752 | FFV_O93209 |
| GGGGGS | 14,753 | FLV_P10273_3mutA |
| EAAAKEAAAKEAAAK | 14,754 | FOAMV_P14350 |
| PAPGGG | 14,755 | MLVCB_P08361_3mut |
| GSSGGSEAAAK | 14,756 | FOAMV_P14350_2mutA |
| GGSPAPGGG | 14,757 | FLV_P10273_3mut |
| GSSGSSGSSGSSGSSGSS | 14,758 | SFV1_P23074-Pro_2mutA |
| GGSPAPEAAAK | 14,759 | SFV3L_P27401 |
| PAPGGGGSS | 14,760 | HTL3P_Q4U0X6_2mutB |
| GGGGSSEAAAK | 14,761 | MMTVB_P03365_2mut_WS |
| PAPGGS | 14,762 | MLVRD_P11227_3mut |
| GGSGGSGGSGGSGGS | 14,763 | MMTVB_P03365 |
| GSAGSAAGSGEF | 14,764 | AVIRE_P03360 |
| GSSGGS | 14,765 | BAEVM_P10272_3mutA |
| GGSGGGGSS | 14,766 | MMTVB_P03365 |
| GGSGGGGSS | 14,767 | WMSV_P03359 |
| PAPEAAAKGSS | 14,768 | SFV1_P23074 |
| GSSGSSGSSGSS | 14,769 | SFV1_P23074-Pro_2mutA |
| PAPAPAPAPAPAP | 14,770 | SFV3L_P27401 |
| PAPGSSGGG | 14,771 | FLV_P10273_3mut |
| GGSGSSPAP | 14,772 | MLVMS_P03355 |
| GGSGGGPAP | 14,773 | FOAMV_P14350 |
| PAPGGGGGS | 14,774 | KORV_Q9TTC1_3mutA |
| EAAAKGSSPAP | 14,775 | GALV_P21414_3mutA |
| GGSGSSPAP | 14,776 | MLVBM_Q7SVK7_3mut |
| EAAAKGSS | 14,777 | SFV3L_P27401_2mut |
| GGGGGSEAAAK | 14,778 | WMSV_P03359 |
| GGGGGGGG | 14,779 | SFV1_P23074-Pro |
| EAAAKEAAAK | 14,780 | MLVBM_Q7SVK7 |
| GGGEAAAKGGS | 14,781 | MLVBM_Q7SVK7 |
| EAAAKGGSPAP | 14,782 | SFV3L_P27401_2mut |
| GSSEAAAK | 14,783 | XMRV6_A1Z651 |
| PAPGGGEAAAK | 14,784 | MMTVB_P03365_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSPAP | 14,785 | GALV_P21414_3mutA |
| GSSPAPGGG | 14,786 | MLVBM_Q7SVK7_3mutA_WS |
| GGSGSSPAP | 14,787 | SFV1_P23074_2mutA |
| GGS | | HTL32_Q0R5R2_2mut |
| GGSGGGGSS | 14,789 | MMTVB_P03365-Pro |
| GGGGSGGGGSGGGGSGGGGS | 14,790 | SFVCP_Q87040_2mutA |
| EAAAKGGGPAP | 14,791 | FOAMV_P14350_2mut |
| GSSGGGEAAAK | 14,792 | MMTVB_P03365 |
| SGGSSGGSSGSETPGTSESATPESSGGSSGGSS | 14,793 | MLVBM_Q7SVK7_3mutA_WS |
| AEAAAKEAAAKEAAAKEAAAKALEAEAAAKEAAAKEAAAKEAAAKA | 14,794 | MMTVB_P03365_WS |
| EAAAKEAAAK | 14,795 | FOAMV_P14350-Pro_2mut |
| GSSPAPEAAAK | 14,796 | FOAMV_P14350_2mutA |
| EAAAKPAPGGS | 14,797 | GALV_P21414_3mutA |
| GSSGGSPAP | 14,798 | KORV_Q9TTC1-Pro_3mut |
| GGGPAPEAAAK | 14,799 | MLVAV_P03356 |
| GGGEAAAKPAP | 14,800 | SFV1_P23074-Pro_2mut |
| GGGGGSEAAAK | 14,801 | SFV3L_P27401_2mut |
| GGGPAPGSS | 14,802 | SFV3L_P27401_2mut |
| GGSEAAAKPAP | 14,803 | AVIRE_P03360 |
| GSSGSSGSSGSSGSSGSS | 14,804 | SFV1_P23074-Pro_2mut |
| EAAAKGSSGGS | 14,805 | FOAMV_P14350_2mutA |
| GGGGGG | 14,806 | MLVBM_Q7SVK7_3mut |
| GSSPAPGGS | 14,807 | PERV_Q4VFZ2 |
| GGSGSSPAP | 14,808 | GALV_P21414_3mutA |
| GGGPAPEAAAK | 14,809 | SFV3L_P27401 |
| GGSGGGEAAAK | 14,810 | WMSV_P03359 |
| GSAGSAAGSGEF | 14,811 | SFV1_P23074_2mut |
| GSSGGGEAAAK | 14,812 | MLVMS_P03355 |
| GGG | | MMTVB_P03365-Pro |
| PAPGSSGGS | 14,814 | FOAMV_P14350_2mut |
| GGGGSSPAP | 14,815 | FFV_O93209_2mut |
| SGGSSGGSSGSETPGTSESATPESSGGSSGGSS | 14,816 | MMTVB_P03365_WS |
| GGGGGGG | 14,817 | XMRV6_A1Z651 |
| PAPAPAPAPAP | 14,818 | FOAMV_P14350 |
| GGGGSGGGGSGGGGSGGGGS | 14,819 | MMTVB_P03365_2mut_WS |
| GGSGGGPAP | 14,820 | SFV3L_P27401_2mut |
| GGGGGG | 14,821 | SFV1_P23074-Pro |
| EAAAKPAPGSS | 14,822 | SFV3L_P27401_2mut |
| GGGGSSGGS | 14,823 | HTL3P_Q4U0X6_2mut |
| PAPGSSEAAAK | 14,824 | MMTVB_P03365-Pro |
| GGGGSSPAP | 14,825 | FOAMV_P14350-Pro_2mut |
| PAPGSSGGS | 14,826 | MMTVB_P03365 |
| AEAAAKEAAAKEAAAKEAAAKALEAEAAAKEAAAKEAAAKEAAAKA | 14,827 | SRV2_P51517 |
| PAPAPAP | 14,828 | MMTVB_P03365_2mut_WS |
| PAPGGGGGS | 14,829 | MMTVB_P03365_2mutB |
| GGGGSS | 14,830 | SFV1_P23074-Pro_2mutA |
| EAAAKEAAAKEAAAKEAAAK | 14,831 | SFV3L_P27401-Pro |
| GGSGGSGGSGGSGGS | 14,832 | MMTVB_P03365-Pro |
| GGGGGGG | 14,833 | SFV3L_P27401_2mut |
| PAPGGGEAAAK | 14,834 | SFV3L_P27401 |
| PAPGSS | 14,835 | FOAMV_P14350_2mutA |
| GGGGSGGGGS | 14,836 | SFVCP_Q87040_2mutA |
| GSSGGSGGG | 14,837 | XMRV6_A1Z651 |
| GGGGSGGGGSGGGGSGGGGSGGGGGSGGGGS | 14,838 | MLVBM_Q7SVK7 |
| GSSEAAAKGGG | 14,839 | FFV_O93209-Pro_2mut |
| GGSEAAAKPAP | 14,840 | SFV3L_P27401-Pro |
| GSSGGSGGG | 14,841 | SFV1_P23074_2mut |
| EAAAKGGGGSS | 14,842 | FOAMV_P14350_2mutA |
| GGGGGG | 14,843 | SFV3L_P27401_2mut |
| GGGGG | 14,844 | MLVBM_Q7SVK7_3mut |
| PAPEAAAKGGG | 14,845 | SFV3L_P27401 |
| EAAAKGGSPAP | 14,846 | KORV_Q9TTC1_3mutA |
| GGGEAAAKPAP | 14,847 | SFV1_P23074_2mut |
| GSSGSSGSSGSSGSSGSS | 14,848 | KORV_Q9TTC1-Pro |
| EAAAKEAAAKEAAAKEAAAK | 14,849 | SFVCP_Q87040 |
| PAPGSSEAAAK | 14,850 | MLVBM_Q7SVK7 |
| GSSGSSGSS | 14,851 | FFV_O93209-Pro_2mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSGGGPAP | 14,852 | SFV3L_P27401-Pro_2mut |
| GGGPAPEAAAK | 14,853 | WMSV_P03359_3mut |
| GGGEAAAK | 14,854 | MMTVB_P03365-Pro |
| GSSGSSGSSGSS | 14,855 | SFV3L_P27401-Pro_2mutA |
| PAPAPAPAPAP | 14,856 | FFV_O93209-Pro |
| GGSPAPEAAAK | 14,857 | FFV_O93209-Pro_2mut |
| GSSGSSGSSGSSGSSGSS | 14,858 | GALV_P21414 |
| EAAAKEAAAKEAAAKEAAAKEAAAK | 14,859 | FOAMV_P14350 |
| GGGPAPEAAAK | 14,860 | MMTVB_P03365-Pro |
| PAPGGSGGG | 14,861 | MLVF5_P26810_3mutA |
| PAPGGSGGG | 14,862 | FLV_P10273_3mut |
| GGGEAAAKGGS | 14,863 | SFV3L_P27401 |
| GSAGSAAGSGEF | 14,864 | MLVBM_Q7SVK7_3mut |
| GSSPAPGGG | 14,865 | MPMV_P07572_2mutB |
| GSSGSSGSSGSSGSSGSS | 14,866 | FOAMV_P14350 |
| GGSGGGGSS | 14,867 | BLVJ_P03361_2mut |
| PAPEAAAKGSS | 14,868 | SFV1_P23074-Pro |
| GGG | | FFV_O93209 |
| EAAAKGGGGSS | 14,870 | SFV1_P23074_2mut |
| EAAAKEAAAKEAAAKEAAAKEAAAKEAAAK | 14,871 | SRV2_P51517 |
| GGGGSGGGGSGGGGSGGGGSGGGGSGGGGS | 14,872 | MMTVB_P03365 |
| GGGEAAAKGGS | 14,873 | MMTVB_P03365_WS |
| GSSGSS | 14,874 | SFV1_P23074 |
| GSSGGGGGS | 14,875 | SFV3L_P27401 |
| GGGGSSEAAAK | 14,876 | SFV1_P23074 |
| EAAAKGSSGGS | 14,877 | HTL1A_P03362_2mutB |
| GSSEAAAKGGS | 14,878 | GALV_P21414_3mutA |
| EAAAKGSSPAP | 14,879 | SFV1_P23074 |
| EAAAKPAPGSS | 14,880 | SFV3L_P27401_2mutA |
| PAPGSSGGG | 14,881 | SFV3L_P27401-Pro_2mut |
| GGGGSGGGGSGGGGSGGGGSGGGGSGGGGS | 14,882 | SFV3L_P27401-Pro |
| EAAAKEAAAKEAAAKEAAAKEAAAK | 14,883 | MMTVB_P03365_WS |
| GGGGSSEAAAK | 14,884 | MLVF5_P26810_3mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| EAAAKGGSPAP | 14,885 | GALV_P21414 |
| PAPEAAAKGSS | 14,886 | MMTVB_P03365_WS |
| GSSGGGGGS | 14,887 | SFVCP_Q87040_2mut |
| GGGGSSPAP | 14,888 | SFV1_P23074 |
| EAAAKGGGGSS | 14,889 | XMRV6_A1Z651 |
| PAPAPAPAP | 14,890 | MMTVB_P03365 |
| GGSEAAAKGSS | 14,891 | SFV3L_P27401_2mutA |
| GSSPAPGGG | 14,892 | MMTVB_P03365_WS |
| GGGGGG | 14,893 | SFV3L_P27401-Pro |
| GGSGGSGGS | 14,894 | FOAMV_P14350-Pro_2mut |
| PAPAPAPAPAPAP | 14,895 | WMSV_P03359 |
| GSSPAP | 14,896 | MLVBM_Q7SVK7 |
| GGGGGSGSS | 14,897 | MMTVB_P03365_2mut_WS |
| EAAAKGSSGGS | 14,898 | MMTVB_P03365_2mutB_WS |
| EAAAK | 14,899 | FFV_O93209_2mutA |
| PAPEAAAK | 14,900 | SFV1_P23074-Pro |
| EAAAKGGSGSS | 14,901 | SFV3L_P27401 |
| GGSGGSGGS | 14,902 | FFV_O93209-Pro |
| GSSGGGEAAAK | 14,903 | MMTVB_P03365 |
| SGGSSGGSSGSETPGTSESATPESSGGSSGGSS | 14,904 | MLVFF_P26809_3mutA |
| GGSGGSGGSGGSGGSGGS | 14,905 | HTL1L_P0C211_2mutB |
| GGGEAAAK | 14,906 | SFV3L_P27401-Pro_2mutA |
| GGGGGSGSS | 14,907 | MMTVB_P03365 |
| GSSPAPGGS | 14,908 | FOAMV_P14350_2mutA |
| EAAAKGSS | 14,909 | MLVMS_P03355 |
| GSSGGSGGG | 14,910 | FFV_O93209-Pro |
| GGSGGGGSS | 14,911 | MMTVB_P03365-Pro_2mut |
| GGSPAPGSS | 14,912 | FOAMV_P14350_2mut |
| GGSGGSGGSGGSGGSGGS | 14,913 | SFVCP_Q87040-Pro_2mut |
| GSSEAAAKGGG | 14,914 | FOAMV_P14350_2mutA |
| GGSGGSGGS | 14,915 | MMTVB_P03365-Pro |
| GSSGSSGSSGSSGSSGSS | 14,916 | MMTVB_P03365_2mut_WS |
| GSSGSSGSSGSSGSS | 14,917 | MMTVB_P03365-Pro |
| PAPEAAAK | 14,918 | WDSV_O92815 |
| GSSGSSGSSGSSGSS | 14,919 | FFV_O93209-Pro_2mut |
| EAAAKGGGGSEAAAK | 14,920 | MMTVB_P03365-Pro |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGSPAPEAAAK | 14,921 | FOAMV_P14350 |
| GSSGSS | 14,922 | PERV_Q4VFZ2 |
| GGG | | MMTVB_P03365-Pro |
| GGGGSGGGGSGGGGS | 14,924 | FFV_O93209_2mut |
| EAAAKEAAAKEAAAKEAAAKEAAAKEAAAK | 14,925 | MMTVB_P03365-Pro |
| GGSGSSPAP | 14,926 | WMSV_P03359 |
| GGGGGGGG | 14,927 | SFV3L_P27401_2mut |
| PAPGSSEAAAK | 14,928 | FOAMV_P14350-Pro_2mutA |
| GGGGSSPAP | 14,929 | FOAMV_P14350_2mut |
| GSSGGSPAP | 14,930 | MLVBM_Q7SVK7_3mut |
| GSSGGGGGS | 14,931 | GALV_P21414_3mutA |
| EAAAKEAAAKEAAAKEAAAKEAAAK | 14,932 | MMTVB_P03365 |
| GSSGGGGGS | 14,933 | SFV1_P23074_2mut |
| GGGGSEAAAKGGGGS | 14,934 | SFV1_P23074 |
| GGGEAAAKPAP | 14,935 | FFV_O93209 |
| PAPGGGEAAAK | 14,936 | SFV1_P23074 |
| GGSGGGEAAAK | 14,937 | PERV_Q4VFZ2_3mutA_WS |
| GSSGGG | 14,938 | MMTVB_P03365-Pro |
| EAAAKGSSGGS | 14,939 | FFV_O93209_2mut |
| GGGGG | 14,940 | SFV1_P23074_2mut |
| GGGPAP | 14,941 | SFV3L_P27401 |
| GSSGGSEAAAK | 14,942 | FFV_O93209 |
| SGGSSGGSSGSETPGTSESATPESSGGSSGGSS | 14,943 | MMTVB_P03365-Pro |
| GSSGGGEAAAK | 14,944 | SFV1_P23074_2mutA |
| GSSGSSGSSGSSGSS | 14,945 | SFV3L_P27401_2mut |
| GGSEAAAKPAP | 14,946 | FLV_P10273 |
| GGGGSGGGGS | 14,947 | FOAMV_P14350-Pro_2mutA |
| GSSEAAAKPAP | 14,948 | SFV3L_P27401 |
| GGGGSEAAAKGGGGS | 14,949 | MMTVB_P03365-Pro |
| PAPGSSEAAAK | 14,950 | MLVF5_P26810_3mut |
| EAAAKGGSGGG | 14,951 | SFV3L_P27401 |
| GGGPAPGGS | 14,952 | SFV3L_P27401 |
| GSSEAAAKGGS | 14,953 | FOAMV_P14350_2mutA |
| EAAAKGGSGGG | 14,954 | HTL1L_P0C211 |
| GSSGGSPAP | 14,955 | SFV3L_P27401_2mutA |
| PAPAP | 14,956 | FFV_O93209 |
| PAPGGSGSS | 14,957 | MMTVB_P03365_WS |
| EAAAKGGGGGS | 14,958 | FOAMV_P14350_2mut |
| PAPEAAAKGGS | 14,959 | SFV3L_P27401_2mut |
| GSSEAAAKPAP | 14,960 | MMTVB_P03365-Pro |
| GGSGGS | 14,961 | PERV_Q4VFZ2_3mut |
| GSSEAAAKGGG | 14,962 | FFV_O93209-Pro_2mutA |
| EAAAK | 14,963 | HTL1L_P0C211 |
| GSSPAP | 14,964 | MLVMS_P03355 |
| EAAAKPAPGGG | 14,965 | FFV_O93209-Pro_2mut |
| GGGGSEAAAKGGGGS | 14,966 | SFV1_P23074-Pro_2mut |
| EAAAKGSSGGS | 14,967 | SFV3L_P27401 |
| GSAGSAAGSGEF | 14,968 | FFV_O93209_2mutA |
| PAPEAAAKGGS | 14,969 | MMTVB_P03365_2mutB_WS |
| EAAAKEAAAKEAAAKEAAAKEAAAKEAAAK | 14,970 | MMTVB_P03365 |
| GGS | | MMTVB_P03365 |
| GGSEAAAKPAP | 14,972 | SFV1_P23074 |
| EAAAKGSSGGG | 14,973 | HTLV2_P03363_2mut |
| GGSEAAAKGGG | 14,974 | MMTVB_P03365_WS |
| GGSGGS | 14,975 | FFV_O93209-Pro |
| GSSEAAAKGGS | 14,976 | MMTVB_P03365-Pro |
| PAPAPAPAPAP | 14,977 | SFV1_P23074_2mutA |
| GGSEAAAKGGG | 14,978 | MMTVB_P03365_2mutB_WS |
| PAPAPAPAP | 14,979 | MMTVB_P03365_WS |
| GGGGSGGGGSGGGGSGGGGSGGGGS | 14,980 | HTL3P_Q4U0X6_2mut |
| PAPGGSEAAAK | 14,981 | SFV1_P23074-Pro_2mut |
| GGSGGGPAP | 14,982 | MMTVB_P03365 |
| GSSGSSGSSGSSGSSGSS | 14,983 | MMTVB_P03365-Pro |
| GGSEAAAKPAP | 14,984 | SFV1_P23074-Pro |
| GGGEAAAKGSS | 14,985 | SFV3L_P27401_2mutA |
| GGGPAPGGS | 14,986 | AVIRE_P03360 |
| PAPGGG | 14,987 | MLVRD_P11227 |
| GGSEAAAKGSS | 14,988 | SFV3L_P27401_2mut |
| GGGEAAAKGSS | 14,989 | FOAMV_P14350_2mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGEAAAKGSS | 14,990 | SFV1_P23074-Pro |
| EAAAKEAAAKEAAAKEAAAK | 14,991 | MLVAV_P03356 |
| EAAAKGGGPAP | 14,992 | JSRV_P31623_2mutB |
| EAAAKGGGGSS | 14,993 | FOAMV_P14350_2mut |
| EAAAKEAAAKEAAAKEAAAKEAAAK | 14,994 | SRV2_P51517 |
| GSSGGGGGS | 14,995 | FFV_O93209 |
| PAPAPAP | 14,996 | FOAMV_P14350_2mutA |
| GGSGGSGGSGGS | 14,997 | FOAMV_P14350 |
| GGGEAAAK | 14,998 | MMTVB_P03365_WS |
| GGGGGS | 14,999 | SFV1_P23074_2mutA |
| GGSGGS | 15,000 | WMSV_P03359_3mut |
| EAAAKGGS | 15,001 | MMTVB_P03365-Pro |
| GGGGSS | 15,002 | BLVJ_P03361_2mut |
| PAPAP | 15,003 | MMTVB_P03365-Pro_2mut |
| PAPGGG | 15,004 | SMRVH_P03364 |
| EAAAKGGGGSS | 15,005 | SFV3L_P27401 |
| PAPAPAPAPAP | 15,006 | MMTVB_P03365 |
| GGGPAP | 15,007 | MMTVB_P03365-Pro |
| GSSGGSGGG | 15,008 | MMTVB_P03365 |
| EAAAKGGGPAP | 15,009 | FOAMV_P14350_2mutA |
| GSSGSSGSSGSS | 15,010 | SFV1_P23074 |
| GGGGSGGGGS | 15,011 | SFV3L_P27401 |
| GSSGGSGGG | 15,012 | MLVF5_P26810 |
| GGGEAAAKPAP | 15,013 | MMTVB_P03365-Pro |
| PAPEAAAK | 15,014 | HTLV2_P03363_2mut |
| GSSGSSGSSGSS | 15,015 | FOAMV_P14350_2mut |
| GSSEAAAKPAP | 15,016 | MMTVB_P03365-Pro |
| PAPEAAAKGGG | 15,017 | HTL3P_Q4U0X6_2mut |
| GGSEAAAKGSS | 15,018 | MMTVB_P03365-Pro |
| EAAAKPAPGGS | 15,019 | MMTVB_P03365_2mut_WS |
| GSSGGSEAAAK | 15,020 | MLVF5_P26810_3mutA |
| GGGGSGGGGSGGGGSGGGGSGGGGGSGGGGS | 15,021 | MLVF5_P26810_3mut |
| EAAAKGGGGSS | 15,022 | MMTVB_P03365-Pro |
| GGGGGSGSS | 15,023 | HTL1A_P03362_2mutB |
| PAPAP | 15,024 | FFV_O93209-Pro_2mut |
| GGGGGSPAP | 15,025 | HTL1C_P14078_2mut |
| GGGPAP | 15,026 | HTLV2_P03363_2mut |
| EAAAKGGGGSEAAAK | 15,027 | SFVCP_Q87040 |
| GGSEAAAKGGG | 15,028 | FFV_O93209-Pro_2mutA |
| GSSPAPGGS | 15,029 | FOAMV_P14350-Pro_2mut |
| GGGGGGG | 15,030 | MMTVB_P03365-Pro |
| EAAAKGSS | 15,031 | SFV3L_P27401_2mutA |
| EAAAKGGGGSEAAAK | 15,032 | MMTVB_P03365-Pro |
| GGGGSEAAAKGGGGS | 15,033 | SFV1_P23074-Pro_2mutA |
| EAAAKGGGGSS | 15,034 | MMTVB_P03365 |
| GGGEAAAKGGS | 15,035 | SFV1_P23074 |
| PAPEAAAKGGG | 15,036 | MLVF5_P26810 |
| GGGGSSGGS | 15,037 | MMTVB_P03365 |
| GGSGSS | 15,038 | MMTVB_P03365 |
| PAPAPAPAPAPAP | 15,039 | KORV_Q9TTC1 |
| EAAAKGGG | 15,040 | SFV1_P23074-Pro_2mut |
| PAPAPAPAPAPAP | 15,041 | SRV2_P51517 |
| GSSGSSGSSGSSGSS | 15,042 | FFV_O93209-Pro_2mutA |
| GGGGSS | 15,043 | FOAMV_P14350_2mut |
| PAPGGGEAAAK | 15,044 | MMTVB_P03365_WS |
| GGSGGGEAAAK | 15,045 | FFV_O93209-Pro_2mut |
| PAPAPAPAPAP | 15,046 | MMTVB_P03365_WS |
| GGGEAAAKGGS | 15,047 | MMTVB_P03365-Pro |
| GGGEAAAKGSS | 15,048 | MMTVB_P03365_2mutB |
| GSSPAPEAAAK | 15,049 | MMTVB_P03365_WS |
| EAAAKEAAAKEAAAKEAAAKEAAAK | 15,050 | SFV1_P23074-Pro_2mutA |
| PAPGGG | 15,051 | SFV3L_P27401 |
| GSSEAAAKGGG | 15,052 | MMTVB_P03365_WS |
| GGGGSSEAAAK | 15,053 | FOAMV_P14350_2mut |
| PAPGSSGGS | 15,054 | SFV1_P23074-Pro_2mut |
| GSSGSSGSSGSSGSSGSS | 15,055 | SFV3L_P27401 |
| EAAAKGSSGGG | 15,056 | MMTVB_P03365 |
| PAPGGGGSS | 15,057 | WDSV_O92815_2mutA |
| GGSPAP | 15,058 | MMTVB_P03365-Pro |
| GGSGGSGGSGGSGGS | 15,059 | SFVCP_Q87040-Pro_2mut |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| PAPAPAPAP | 15,060 | MMTVB_P03365-Pro |
| GGGGG | 15,061 | HTL1A_P03362 |
| GGSGGSGGSGGS | 15,062 | SFV1_P23074_2mutA |
| GSSGSSGSSGSSGSS | 15,063 | FOAMV_P14350-Pro_2mut |
| PAPGGSEAAAK | 15,064 | MMTVB_P03365_2mutB_WS |
| PAPAPAPAP | 15,065 | SFV1_P23074_2mut |
| PAPGGGGSS | 15,066 | MMTVB_P03365 |
| GGSGSS | 15,067 | SFV3L_P27401_2mut |
| EAAAKEAAAKEAAAKEAAAK | 15,068 | MMTVB_P03365_2mut |
| EAAAKGGSGGG | 15,069 | HTL3P_Q4U0X6_2mut |
| PAPGGGGSS | 15,070 | SFVCP_Q87040-Pro_2mutA |
| EAAAKGGGGGS | 15,071 | MLVAV_P03356 |
| GGGGGS | 15,072 | FOAMV_P14350_2mut |
| GGGEAAAKGGS | 15,073 | FFV_O93209-Pro_2mutA |
| EAAAKPAPGGG | 15,074 | MMTVB_P03365_2mutB |
| GGSGGGPAP | 15,075 | FFV_O93209_2mut |
| GSSEAAAKPAP | 15,076 | MMTVB_P03365 |
| PAPAPAPAPAPAP | 15,077 | SFV1_P23074_2mut |
| GGSPAPGGG | 15,078 | MMTVB_P03365-Pro |
| GGSGGGEAAAK | 15,079 | MMTVB_P03365 |
| PAPAP | 15,080 | SFVCP_Q87040 |
| GSSEAAAK | 15,081 | SFVCP_Q87040 |
| GGGGSGGGGSGGGGS | 15,082 | MMTVB_P03365-Pro |
| GSSGSSGSS | 15,083 | SFV3L_P27401 |
| EAAAKGGSGGG | 15,084 | MMTVB_P03365-Pro |
| GSSPAP | 15,085 | SFV1_P23074_2mut |
| GGGEAAAK | 15,086 | SFV1_P23074-Pro |
| AEAAAKEAAAKEAAAKEAAAKALEAEAAAKEAAAKEAAAKEAAAKA | 15,087 | MMTVB_P03365-Pro |
| PAPGGS | 15,088 | HTL1C_P14078_2mut |
| PAPGSSGGS | 15,089 | SFV1_P23074_2mut |
| PAPEAAAK | 15,090 | MMTVB_P03365_WS |
| PAPAP | 15,091 | MMTVB_P03365-Pro |
| EAAAKGGS | 15,092 | HTL1A_P03362_2mut |
| GGGGSEAAAKGGGGS | 15,093 | HTL1C_P14078 |
| EAAAKGSSGGS | 15,094 | FOAMV_P14350-Pro |
| PAPGGSGSS | 15,095 | MMTVB_P03365-Pro |
| PAPGGSEAAAK | 15,096 | SFV1_P23074_2mut |
| PAPGSSEAAAK | 15,097 | FFV_O93209-Pro_2mut |
| PAPGSSGGG | 15,098 | FOAMV_P14350-Pro_2mutA |
| GSSGGGEAAAK | 15,099 | AVIRE_P03360 |
| GGGGGG | 15,100 | SMRVH_P03364_2mut |
| PAPEAAAKGGG | 15,101 | MMTVB_P03365-Pro |
| GGGEAAAKGGS | 15,102 | SFVCP_Q87040_2mutA |
| PAPAPAPAPAP | 15,103 | SRV2_P51517 |
| GSSGSSGSSGSSGSSGSS | 15,104 | MMTVB_P03365 |
| EAAAKGGGPAP | 15,105 | MLVAV_P03356 |
| PAPAPAPAPAP | 15,106 | FOAMV_P14350-Pro_2mutA |
| PAPGGSEAAAK | 15,107 | FOAMV_P14350 |
| GSSGGGPAP | 15,108 | HTL32_Q0R5R2_2mutB |
| GGGGGSPAP | 15,109 | HTL3P_Q4U0X6_2mutB |
| GSSGGSGGG | 15,110 | MMTVB_P03365-Pro |
| PAPAP | 15,111 | SFVCP_Q87040-Pro |
| GSSGGGPAP | 15,112 | MMTVB_P03365-Pro |
| GGSGSS | 15,113 | MMTVB_P03365-Pro_2mut |
| GGSPAPEAAAK | 15,114 | SFV1_P23074-Pro_2mut |
| EAAAKGGSGGG | 15,115 | SFV3L_P27401_2mut |
| GGGGSSEAAAK | 15,116 | MMTVB_P03365_WS |
| GGGGGSGSS | 15,117 | MMTVB_P03365_2mut |
| GGGGSSGGS | 15,118 | SFV1_P23074-Pro_2mutA |
| EAAAKGGGGSEAAAK | 15,119 | MMTVB_P03365_WS |
| PAPGGGEAAAK | 15,120 | SFV1_P23074-Pro |
| PAPEAAAKGGG | 15,121 | MMTVB_P03365 |
| AEAAAKEAAAKEAAAKEAAAKALEAEAAAKEAAAKEAAAKEAAAKA | 15,122 | MMTVB_P03365 |
| GSSGGSEAAAK | 15,123 | FOAMV_P14350-Pro_2mut |
| GGSPAP | 15,124 | MLVBM_Q7SVK7_3mut |
| GSSEAAAK | 15,125 | FOAMV_P14350 |
| GSSEAAAK | 15,126 | MMTVB_P03365-Pro |
| EAAAKGSSGGS | 15,127 | HTL1A_P03362_2mut |
| GGGEAAAKPAP | 15,128 | FOAMV_P14350-Pro_2mut |
| EAAAKGGSPAP | 15,129 | FOAMV_P14350 |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSEAAAKPAP | 15,130 | MMTVB_P03365_WS |
| GSSGSSGSS | 15,131 | FOAMV_P14350_2mut |
| EAAAKEAAAKEAAAKEAAAK | 15,132 | MMTVB_P03365_WS |
| EAAAK | 15,133 | MMTVB_P03365 |
| PAPGSS | 15,134 | BAEVM_P10272 |
| PAPGGS | 15,135 | FFV_O93209-Pro_2mut |
| GGSGGS | 15,136 | SFV1_P23074-Pro_2mutA |
| SGGSSGGSSGSETPGTSESATPESSGGSSGGSS | 15,137 | HTLV2_P03363_2mut |
| GGSGGGEAAAK | 15,138 | MMTVB_P03365_WS |
| PAPGSSGGG | 15,139 | HTL1A_P03362 |
| GGSGGS | 15,140 | SFV3L_P27401-Pro |
| GSSGSS | 15,141 | SFV1_P23074-Pro |
| PAPGGSEAAAK | 15,142 | MMTVB_P03365 |
| GSAGSAAGSGEF | 15,143 | MMTVB_P03365-Pro |
| PAPGGG | 15,144 | FOAMV_P14350_2mut |
| EAAAKGGSGSS | 15,145 | MMTVB_P03365_WS |
| GSSGGGEAAAK | 15,146 | SFV3L_P27401-Pro |
| GGSGGGPAP | 15,147 | FOAMV_P14350-Pro_2mut |
| PAPAPAPAPAPAP | 15,148 | WDSV_O92815 |
| SGSETPGTSESATPES | 15,149 | SFVCP_Q87040-Pro_2mutA |
| GGSGGSGGS | 15,150 | SFV1_P23074 |
| GGGGSS | 15,151 | SFVCP_Q87040_2mut |
| GGGGGSEAAAK | 15,152 | MMTVB_P03365 |
| SGSETPGTSESATPES | 15,153 | MMTVB_P03365_WS |
| PAPAPAP | 15,154 | SFV3L_P27401 |
| PAPEAAAKGSS | 15,155 | MMTVB_P03365_2mutB_WS |
| GSSGSSGSSGSSGSS | 15,156 | SRV2_P51517 |
| GGGPAPGSS | 15,157 | HTL32_Q0R5R2_2mutB |
| GGSGGGGSS | 15,158 | MMTVB_P03365-Pro |
| SGSETPGTSESATPES | 15,159 | SRV2_P51517 |
| EAAAKGSSGGS | 15,160 | MMTVB_P03365-Pro |
| GSSPAPEAAAK | 15,161 | MMTVB_P03365-Pro |
| GSSPAPEAAAK | 15,162 | SRV2_P51517 |
| GGGGSSPAP | 15,163 | MMTVB_P03365-Pro |
| PAPGGGEAAAK | 15,164 | SFV1_P23074-Pro_2mutA |
| PAPEAAAKGGS | 15,165 | MMTVB_P03365 |
| GSSGSSGSSGSSGSSGSS | 15,166 | FOAMV_P14350-Pro |
| GGSPAPGSS | 15,167 | SFV3L_P27401 |
| GGGPAPGGS | 15,168 | SFV1_P23074-Pro_2mutA |
| GGGPAPGSS | 15,169 | MMTVB_P03365-Pro |
| EAAAKPAP | 15,170 | MLVBM_Q7SVK7 |
| EAAAKEAAAKEAAAK | 15,171 | HTL1C_P14078 |
| GSSGGSEAAAK | 15,172 | SRV2_P51517 |
| PAPGGGGGS | 15,173 | SRV2_P51517 |
| GGGEAAAK | 15,174 | FFV_O93209-Pro_2mut |
| EAAAKGGGPAP | 15,175 | HTL32_Q0R5R2 |
| GGSGSSGGG | 15,176 | MMTVB_P03365 |
| PAPEAAAKGSS | 15,177 | MMTVB_P03365-Pro |
| PAPGGGGGS | 15,178 | MMTVB_P03365-Pro |
| EAAAKGGGGGS | 15,179 | MMTVB_P03365_WS |
| GGGGGS | 15,180 | MMTVB_P03365-Pro |
| GGGGSGGGGSGGGGSGGGGSGGGGS | 15,181 | HTL1C_P14078 |
| EAAAKGGSPAP | 15,182 | MMTVB_P03365 |
| GGGGSSPAP | 15,183 | FFV_O93209-Pro_2mut |
| GGGGSSGGS | 15,184 | MMTVB_P03365-Pro |
| PAPGSSGGS | 15,185 | MMTVB_P03365-Pro |
| GGGGGS | 15,186 | SRV2_P51517 |
| GGSGSSGGG | 15,187 | MMTVB_P03365 |
| GSSGGSEAAAK | 15,188 | MMTVB_P03365-Pro |
| EAAAKEAAAKEAAAKEAAAK | 15,189 | GALV_P21414 |
| GGSEAAAKGGG | 15,190 | MMTVB_P03365-Pro |
| SGGSSGGSSGSETPGTSESATPESSGGSSGGSS | 15,191 | MMTVB_P03365-Pro |
| GSSEAAAKGGS | 15,192 | MMTVB_P03365 |
| GGGGSGGGGSGGGGSGGGGSGGGGSGGGGS | 15,193 | HTL3P_Q4U0X6_2mutB |
| GGGEAAAK | 15,194 | MMTVB_P03365-Pro |
| PAPAPAPAP | 15,195 | MMTVB_P03365-Pro |
| PAPGSSGGG | 15,196 | MMTVB_P03365 |
| GSSGSSGSSGSSGSS | 15,197 | GALV_P21414 |
| GGSPAP | 15,198 | MMTVB_P03365_WS |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GGGGSGGGGSGGGGSGGGGSGGGGSGGGGS | 15,199 | MMTVB_P03365-Pro |
| PAPEAAAK | 15,200 | MMTVB_P03365-Pro |
| PAPGSSGGG | 15,201 | SFV1_P23074-Pro_2mutA |
| GGGGGSEAAAK | 15,202 | MMTVB_P03365_2mutB_WS |
| PAPAPAPAPAP | 15,203 | MMTVB_P03365-Pro |
| EAAAKGGSGSS | 15,204 | MMTVB_P03365-Pro |
| EAAAKEAAAKEAAAKEAAAK | 15,205 | MLVRD_P11227_3mut |
| PAPAPAPAP | 15,206 | FOAMV_P14350_2mutA |
| GGGPAPGSS | 15,207 | SFVCP_Q87040_2mut |
| PAPEAAAKGSS | 15,208 | SFVCP_Q87040_2mut |
| GGSPAPGGG | 15,209 | MMTVB_P03365-Pro |
| GGGGSGGGGSGGGGSGGGGS | 15,210 | MMTVB_P03365 |
| EAAAKGGS | 15,211 | HTL3P_Q4U0X6_2mut |
| PAPGSSGGS | 15,212 | MMTVB_P03365_WS |
| GGGGSGGGGS | 15,213 | MMTVB_P03365 |
| GGSGGS | 15,214 | FOAMV_P14350 |
| EAAAKGGGGSEAAAK | 15,215 | SFVCP_Q87040-Pro_2mut |
| EAAAKEAAAKEAAAKEAAAK | 15,216 | MMTVB_P03365-Pro_2mutB |
| PAPGGGEAAAK | 15,217 | SFVCP_Q87040-Pro |
| GSSGSS | 15,218 | JSRV_P31623_2mutB |
| EAAAKGGGGGS | 15,219 | MMTVB_P03365_2mut_WS |
| GSSPAPEAAAK | 15,220 | MMTVB_P03365-Pro |
| GGGEAAAK | 15,221 | HTL1C_P14078 |
| PAPEAAAKGSS | 15,222 | HTL32_Q0R5R2_2mutB |
| GGGGSSEAAAK | 15,223 | MMTVB_P03365-Pro |
| PAPGSSGGS | 15,224 | MMTVB_P03365-Pro |
| EAAAKGGGGGS | 15,225 | MMTVB_P03365 |
| GGGGSGGGGSGGGGSGGGGS | 15,226 | MMTVB_P03365 |
| EAAAKGGGGSS | 15,227 | HTL3P_Q4U0X6_2mut |
| GGGEAAAKGGS | 15,228 | SFVCP_Q87040-Pro |
| GGGGGSPAP | 15,229 | MMTVB_P03365-Pro_2mutB |
| GGSGGGEAAAK | 15,230 | SFV3L_P27401-Pro |
| PAPGGGGGS | 15,231 | SFV3L_P27401-Pro |
| EAAAKGGGGSEAAAK | 15,232 | MMTVB_P03365 |
| PAPEAAAKGSS | 15,233 | MMTVB_P03365-Pro |
| GGSEAAAKGGG | 15,234 | MMTVB_P03365-Pro |
| GGSGGSGGSGGSGGS | 15,235 | SMRVH_P03364_2mutB |
| GGSGGSGGSGGSGGS | 15,236 | HTL1L_P0C211_2mut |
| GGGGGG | 15,237 | WDSV_O92815 |
| GGGGGSGSS | 15,238 | MMTVB_P03365-Pro |
| GGSEAAAKPAP | 15,239 | SFV3L_P27401-Pro_2mut |
| GGGPAPGSS | 15,240 | MMTVB_P03365_2mut_WS |
| GGGGGS | 15,241 | MMTVB_P03365_WS |
| GGSPAPEAAAK | 15,242 | MMTVB_P03365 |
| PAPEAAAKGGS | 15,243 | HTL1A_P03362 |
| EAAAKGGSGSS | 15,244 | MMTVB_P03365_2mut_WS |
| GGGPAPEAAAK | 15,245 | SFV3L_P27401-Pro_2mut |
| PAPGGGGSS | 15,246 | HTL32_Q0R5R2_2mut |
| GSSPAPGGG | 15,247 | HTL3P_Q4U0X6_2mut |
| GGGGSSGGS | 15,248 | BLVAU_P25059_2mut |
| EAAAKGGGGGS | 15,249 | HTL1L_P0C211 |
| GGSEAAAKGSS | 15,250 | JSRV_P31623_2mutB |
| GSSGGG | 15,251 | JSRV_P31623 |
| GGSGGSGGSGGS | 15,252 | MMTVB_P03365-Pro |
| EAAAKPAP | 15,253 | SFV1_P23074-Pro_2mutA |
| GGGGSSGGS | 15,254 | MMTVB_P03365_WS |
| GGSGGS | 15,255 | MMTVB_P03365_WS |
| EAAAKGGGGGS | 15,256 | MMTVB_P03365-Pro |
| GGGGSGGGGSGGGGSGGGGSGGGGSGGGGS | 15,257 | MMTVB_P03365 |
| GGSGGSGGS | 15,258 | MMTVB_P03365 |
| GGGGGSEAAAK | 15,259 | MLVBM_Q7SVK7 |
| GGSGSSPAP | 15,260 | MMTVB_P03365_WS |
| EAAAKEAAAKEAAAK | 15,261 | JSRV_P31623 |
| PAPEAAAKGGS | 15,262 | MMTVB_P03365-Pro |
| GGSGSSEAAAK | 15,263 | FOAMV_P14350 |
| GGGGGSGSS | 15,264 | MMTVB_P03365-Pro_2mut |
| GGGPAPGGS | 15,265 | MMTVB_P03365 |
| SGSETPGTSESATPES | 15,266 | SFVCP_Q87040_2mut |
| GSSPAPGGS | 15,267 | SFV1_P23074-Pro_2mutA |

TABLE D-continued

Combinations of linker and RT sequences screened. The amino acid sequence of each RT in this table is provided in Table 6.

| Linker amino acid sequence | SEQ ID NO: | RT domain name |
|---|---|---|
| GSSGSSGSSGSSGSS | 15,268 | MMTVB_P03365 |
| EAAAKGGGPAP | 15,269 | MMTVB_P03365 |
| GSSGGG | 15,270 | MMTVB_P03365_2mut_WS |
| GGGEAAAKPAP | 15,271 | MMTVB_P03365 |
| PAPGGSGGG | 15,272 | MMTVB_P03365-Pro |
| GSSGGSGGG | 15,273 | WDSV_O92815_2mut |
| GGSGGG | 15,274 | HTL32_Q0R5R2_2mut |
| EAAAKGGSPAP | 15,275 | HTLV2_P03363_2mut |
| GGSPAPEAAAK | 15,276 | MMTVB_P03365-Pro |
| GSSGGSEAAAK | 15,277 | MMTVB_P03365_2mut |
| GSAGSAAGSGEF | 15,278 | MMTVB_P03365_WS |
| PAPGGSGSS | 15,279 | FFV_O93209 |
| GGSEAAAKGGG | 15,280 | MMTVB_P03365 |
| GGSPAPGSS | 15,281 | MMTVB_P03365-Pro |
| GSSGGSGGG | 15,282 | SFV3L_P27401 |
| PAPEAAAKGGG | 15,283 | HTL1A_P03362_2mutB |
| GGGEAAAKPAP | 15,284 | MMTVB_P03365-Pro |
| GGSEAAAK | 15,285 | HTL32_Q0R5R2_2mutB |
| GGGEAAAKGSS | 15,286 | MPMV_P07572 |
| GGGGGSEAAAK | 15,287 | MMTVB_P03365-Pro |
| PAPAPAPAPAP | 15,288 | SFVCP_Q87040-Pro_2mutA |
| PAPAPAPAPAP | 15,289 | HTL1L_P0C211_2mut |
| GGGGSSGGS | 15,290 | HTL3P_Q4U0X6 |
| PAPGGSEAAAK | 15,291 | MMTVB_P03365_2mut_WS |
| PAPAPAPAPAP | 15,292 | HTL1A_P03362 |
| EAAAKPAPGGG | 15,293 | MMTVB_P03365_2mut_WS |
| GGSEAAAK | 15,294 | MMTVB_P03365_2mut_WS |
| GGGEAAAKGSS | 15,295 | SFV1_P23074-Pro_2mutA |
| GGSPAPGSS | 15,296 | MMTVB_P03365-Pro |
| GGSEAAAKPAP | 15,297 | MLVBM_Q7SVK7 |
| PAPEAAAKGGG | 15,298 | MMTVB_P03365_2mut_WS |
| GSSEAAAKPAP | 15,299 | MMTVB_P03365-Pro_2mutB |
| GGGGSEAAAKGGGGS | 15,300 | MMTVB_P03365-Pro_2mut |
| GSSEAAAKGGS | 15,301 | MMTVB_P03365-Pro_2mutB |
| GSSGSSGSSGSSGSS | 15,302 | SRV2_P51517_2mutB |
| GGGGGSPAP | 15,303 | HTL1L_P0C211_2mut |
| GGSEAAAK | 15,304 | MMTVB_P03365 |
| GSSPAPEAAAK | 15,305 | SMRVH_P03364_2mutB |
| GGGPAPGGS | 15,306 | HTL1C_P14078_2mut |
| GGSPAPEAAAK | 15,307 | MMTVB_P03365_WS |
| GGSEAAAKPAP | 15,308 | HTL1A_P03362_2mut |
| PAPAPAPAP | 15,309 | HTLV2_P03363_2mut |
| GSSPAPGGG | 15,310 | MMTVB_P03365 |
| GSSGSSGSSGSS | 15,311 | MMTVB_P03365-Pro |
| GGSEAAAKGSS | 15,312 | MMTVB_P03365_WS |
| GGSGSSGGG | 15,313 | MMTVB_P03365_2mutB |
| GSSGSSGSSGSSGSSGSS | 15,314 | JSRV_P31623_2mutB |
| GGSEAAAKPAP | 15,315 | MMTVB_P03365-Pro |
| GSSGGSGGG | 15,316 | HTLV2_P03363_2mut |
| AEAAAKEAAAKEAAAKEA AAKALEAEAAAKEAAAKE AAAKEAAAKA | 15,317 | WDSV_O92815_2mut |
| GGSPAPEAAAK | 15,318 | MMTVB_P03365 |
| GGGGSSEAAAK | 15,319 | MMTVB_P03365 |
| GGSGGGEAAAK | 15,320 | SFV1_P23074-Pro_2mutA |
| GGGGSEAAAKGGGGS | 15,321 | WDSV_O92815_2mut |
| GGSGSSEAAAK | 15,322 | MMTVB_P03365_2mutB_WS |
| GGSEAAAKPAP | 15,323 | MMTVB_P03365_WS |
| GSSGGGEAAAK | 15,324 | SFVCP_Q87040-Pro |
| GSSGGS | 15,325 | SFVCP_Q87040-Pro_2mut |
| GGSEAAAKPAP | 15,326 | SFVCP_Q87040_2mut |
| GSSGGSEAAAK | 15,327 | SFVCP_Q87040_2mut |
| GSSPAPEAAAK | 15,328 | SRV2_P51517_2mutB |
| GGSGGSGGSGGSGGSGGS | 15,329 | BLVAU_P25059 |
| GSSGSSGSSGSSGSS | 15,330 | HTL1C_P14078_2mut |
| EAAAKGGGGSS | 15,331 | MMTVB_P03365_2mutB |
| GGGEAAAKGSS | 15,332 | SFVCP_Q87040-Pro |

Example 3: Quantifying Activity of a Gene Editing Polypeptide and Template for Rewriting the Endogenous FAH Locus Achieved in Primary Mouse Hepatocytes This example demonstrates the use of a gene modifying system containing a gene modifying polypeptide and a template RNA, to convert an A nucleotide to a G nucleotide in the endogenous Fah locus in mouse primary hepatocytes derived from a Fah5981SB mouse. The Fah5981SB mouse model harbors a G to A point mutation in the last nucleotide of exon 8 of the Fah gene, leading to aberrant mRNA splicing and subsequent mRNA degradation, without the production of Fah protein and, and thus serves as a mouse model of hereditary tyrosinemia type I.

In this example, the template RNA contained:

(1) a gRNA spacer;

(2) a gRNA scaffold;

(3) a heterologous object sequence; and (4) a primer binding site (PBS) sequence.

More specifically, the template RNA (including chemical modification pattern) comprised the following sequences:

```
FAH1_R14_P12_Heavy
RNACS048-001
                                    (SEQ ID NO: 30421)
mG*mG*mA*rUrGrGrUrCrCrUrCrArUrGrArArCrGr
ArCrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCrUrUr
ArCrCrGrCrUrCrCrArGrUrCrGrUrUrCrArUrGrAr
G*mG*mA*mC

FAH1_R15_P10_Heavy
RNACS049-001
                                    (SEQ ID NO: 30422)
mG*mG*mA*rUrGrGrUrCrCrUrCrArUrGrArArCrGr
ArCrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCrArUr
UrArCrCrGrCrUrCrCrArGrUrCrGrUrUrCrArUrG*
mA*mG*Mg

FAH2_R19_P11_MUT_Heavy
RNACS052-001
                                    (SEQ ID NO: 30423)
mU*mC*mA*rGrArGrGrArArGrCrUrGrGrGrCrCrAr
CrCrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCrUrGr
GrArGrCrGrGrUrArArUrGrGrCrUrGrGrUrGrGrCr
CrCrArGrC*mU*mU*mC

FAH2_R19_P13_MUT_Heavy
RNACS053-001
                                    (SEQ ID NO: 30424)
mU*mC*mA*rGrArGrGrArArGrCrUrGrGrGrCrCrAr
CrCrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
```

-continued

```
GmUmGmGmCmAmCmCmGmAmGmUmCmGmGmUmGmCrUrGr
GrArGrCrGrGrUrArArUrGrGrCrUrGrGrUrGrGrCr
CrCrArGrCrUrU*mC*mC*mU
```

Additional exemplary template RNAs that could be utilized in this experiment include the following:

```
FAH1
RNACS050
                                    (SEQ ID NO: 30425)
mG*mG*mA*rUrGrGrUrCrCrUrCrArUrGrArArCrGr
ArCrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCrArGr
GrCrArUrUrArCrCrGrCrUrCrCrArGrUrCrGrUrUr
CrArUrGrArG*mG*mA*m
C

FAH1
RNACS051
                                    (SEQ ID NO: 30426)
mG*mG*mA*rUrGrGrUrCrCrUrCrArUrGrArArCrGr
ArCrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCrArGr
GrCrArUrUrArCrCrGrCrUrCrCrArGrUrCrGrUrUr
CrArUrG*mA*mG*mG
```

In the sequences above m=2'-O-methyl ribonucleotide, r=ribose and *=phosphorothioate bond.

The gene modifying polypeptides tested comprised sequence of: RNAV209 (nCas9-RT) and RNAV214 (wt-Cas9-RT). Specifically, the nCas9-RT and the wtCas9-RT had the following amino acid sequences:

```
nCas9-RT (RNAV209):
                                    (SEQ ID NO: 30427)
MPAAKRVKLDGGDKKYSIGLDIGTNSVGWAVITDEYKVPS
KKFKVLGNTDRHSIKKNLIGALLFDSGETAEATRLKRTAR
RRYTRRKNRICYLQEIFSNEMAKVDDSFFHRLEESFLVEE
DKKHERHPIFGNIVDEVAYHEKYPTIYHLRKKLVDSTDKA
DLRLIYLALAHMIKFRGHFLIEGDLNPDNSDVDKLFIQLV
QTYNQLFEENPINASGVDAKAILSARLSKSRRLENLIAQL
PGEKKNGLFGNLIALSLGLTPNFKSNFDLAEDAKLQLSKD
TYDDDLDNLLAQIGDQYADLFLAAKNLSDAILLSDILRVN
TEITKAPLSASMIKRYDEHHQDLTLLKALVRQQLPEKYKE
IFFDQSKNGYAGYIDGGASQEEFYKFIKPILEKMDGTEEL
LVKLNREDLLRKQRTFDNGSIPHQIHLGELHAILRRQEDF
YPFLKDNREKIEKILTFRIPYYVGPLARGNSRFAWMTRKS
```

-continued

EETITPWNFEEVVDKGASAQSFIERMTNFDKNLPNEKVLP

KHSLLYEYFTVYNELTKVKYVTEGMRKPAFLSGEQKKAIV

DLLFKTNRKVTVKQLKEDYFKKIECFDSVEISGVEDRFNA

SLGTYHDLLKIIKDKDFLDNEENEDILEDIVLTLTLFEDR

EMIEERLKTYAHLFDDKVMKQLKRRRYTGWGRLSRKLING

IRDKQSGKTILDFLKSDGFANRNFMQLIHDDSLTFKEDIQ

KAQVSGQGDSLHEHIANLAGSPAIKKGILQTVKVVDELVK

VMGRHKPENIVIEMARENQTTQKGQKNSRERMKRIEEGIK

ELGSQILKEHPVENTQLQNEKLYLYYLQNGRDMYVDQELD

INRLSDYDVDHIVPQSFLKDDSIDNKVLTRSDKARGKSDN

VPSEEVVKKMKNYWRQLLNAKLITQRKFDNLTKAERGGLS

ELDKAGFIKRQLVETRQITKHVAQILDSRMNTKYDENDKL

IREVKVITLKSKLVSDFRKDFQFYKVREINNYHHAHDAYL

NAVVGTALIKKYPKLESEFVYGDYKVYDVRKMIAKSEQEI

GKATAKYFFYSNIMNFFKTEITLANGEIRKRPLIETNGET

GEIVWDKGRDFATVRKVLSMPQVNIVKKTEVQTGGFSKES

ILPKRNSDKLIARKKDWDPKKYGGFDSPTVAYSVLVVAKV

EKGKSKKLKSVKELLGITIMERSSFEKNPIDFLEAKGYKE

VKKDLIIKLPKYSLFELENGRKRMLASAGELQKGNELALP

SKYVNFLYLASHYEKLKGSPEDNEQKQLFVEQHKHYLDEI

IEQISEFSKRVILADANLDKVLSAYNKHRDKPIREQAENI

IHLFTLTNLGAPAAFKYFDTTIDRKRYTSTKEVLDATLIH

QSITGLYETRIDLSQLGGDSGGSSGGSSGSETPGTSESAT

PESSGGSSGGSSTLNIEDEYRLHETSKEPDVSLGSTWLSD

FPQAWAETGGMGLAVRQAPLIIPLKATSTPVSIKQYPMSQ

EARLGIKPHIQRLLDQGILVPCQSPWNTPLLPVKKPGTND

YRPVQDLREVNKRVEDIHPTVPNPYNLLSGLPPSHQWYTV

LDLKDAFFCLRLHPTSQPLFAFEWRDPEMGISGQLTWTRL

PQGFKNSPTLFNEALHRDLADFRIQHPDLILLQYVDDLLL

AATSELDCQQGTRALLQTLGNLGYRASAKKAQICQKQVKY

LGYLLKEGQRWLTEARKETVMGQPTPKTPRQLREFLGKAG

FCRLFIPGFAEMAAPLYPLTKPGTLFNWGPDQQKAYQEIK

QALLTAPALGLPDLTKPFELFVDEKQGYAKGVLTQKLGPW

RRPVAYLSKKLDPVAAGWPPCLRMVAAIAVLTKDAGKLTM

GQPLVILAPHAVEALVKQPPDRWLSNARMTHYQALLLDTD

RVQFGPVVALNPATLLPLPEEGLQHNCLDILAEAHGTRPD

LTDQPLPDADHTWYTDGSSLLQEGQRKAGAAVTTETEVIW

AKALPAGTSAQRAELIALTQALKMAEGKKLNVYTDSRYAF

-continued

ATAHIHGEIYRRRGWLTSEGKEIKNKDEILALLKALFLPK

RLSIIHCPGHQKGHSAEARGNRMADQAARKAAITETPDTS

TLLIENSSPSGGSKRTADGSEFEKRTADGSEFESPKKKAK

VE wtCas9-RT (RNAV214-040):

(SEQ ID NO: 30428)

MPAAKRVKLDGGDKKYSIGLDIGTNSVGWAVITDEYKVPS

KKFKVLGNTDRHSIKKNLIGALLFDSGETAEATRLKRTAR

RRYTRRKNRICYLQEIFSNEMAKVDDSFFHRLEESFLVEE

DKKHERHPIFGNIVDEVAYHEKYPTIYHLRKKLVDSTDKA

DLRLIYLALAHMIKFRGHFLIEGDLNPDNSDVDKLFIQLV

QTYNQLFEENPINASGVDAKAILSARLSKSRRLENLIAQL

PGEKKNGLFGNLIALSLGLTPNFKSNFDLAEDAKLQLSKD

TYDDDLDNLLAQIGDQYADLFLAAKNLSDAILLSDILRVN

TEITKAPLSASMIKRYDEHHQDLTLLKALVRQQLPEKYKE

IFFDQSKNGYAGYIDGGASQEEFYKFIKPILEKMDGTEEL

LVKLNREDLLRKQRTFDNGSIPHQIHLGELHAILRRQEDF

YPFLKDNREKIEKILTFRIPYYVGPLARGNSRFAWMTRKS

EETITPWNFEEVVDKGASAQSFIERMTNFDKNLPNEKVLP

KHSLLYEYFTVYNELTKVKYVTEGMRKPAFLSGEQKKAIV

DLLFKTNRKVTVKQLKEDYFKKIECFDSVEISGVEDRFNA

SLGTYHDLLKIIKDKDFLDNEENEDILEDIVLTLTLFEDR

EMIEERLKTYAHLFDDKVMKQLKRRRYTGWGRLSRKLING

IRDKQSGKTILDFLKSDGFANRNFMQLIHDDSLTFKEDIQ

KAQVSGQGDSLHEHIANLAGSPAIKKGILQTVKVVDELVK

VMGRHKPENIVIEMARENQTTQKGQKNSRERMKRIEEGIK

ELGSQILKEHPVENTQLQNEKLYLYYLQNGRDMYVDQELD

INRLSDYDVDHIVPQSFLKDDSIDNKVLTRSDKNRGKSDN

VPSEEVVKKMKNYWRQLLNAKLITQRKFDNLTKAERGGLS

ELDKAGFIKRQLVETRQITKHVAQILDSRMNTKYDENDKL

IREVKVITLKSKLVSDFRKDFQFYKVREINNYHHAHDAYL

NAVVGTALIKKYPKLESEFVYGDYKVYDVRKMIAKSEQEI

GKATAKYFFYSNIMNFFKTEITLANGEIRKRPLIETNGET

GEIVWDKGRDFATVRKVLSMPQVNIVKKTEVQTGGFSKES

ILPKRNSDKLIARKKDWDPKKYGGFDSPTVAYSVLVVAKV

EKGKSKKLKSVKELLGITIMERSSFEKNPIDFLEAKGYKE

VKKDLIIKLPKYSLFELENGRKRMLASAGELQKGNELALP

SKYVNFLYLASHYEKLKGSPEDNEQKQLFVEQHKHYLDEI

IEQISEFSKRVILADANLDKVLSAYNKHRDKPIREQAENI

IHLFTLTNLGAPAAFKYFDTTIDRKRYTSTKEVLDATLIH

QSITGLYETRIDLSQLGGDSGGSSGGSSGSETPGTSESAT

PESSGGSSGGSSTLNIEDEYRLHETSKEPDVSLGSTWLSD

-continued

```
FPQAWAETGGMGLAVRQAPLIIPLKATSTPVSIKQYPMSQ

EARLGIKPHIQRLLDQGILVPCQSPWNTPLLPVKKPGTND

YRPVQDLREVNKRVEDIHPTVPNPYNLLSGLPPSHQWYTV

LDLKDAFFCLRLHPTSQPLFAFEWRDPEMGISGQLTWTRL

PQGFKNSPTLFNEALHRDLADFRIQHPDLILLQYVDDLLL

AATSELDCQQGTRALLQTLGNLGYRASAKKAQICQKQVKY

LGYLLKEGQRWLTEARKETVMGQPTPKTPRQLREFLGKAG

FCRLFIPGFAEMAAPLYPLTKPGTLFNWGPDQQKAYQEIK

QALLTAPALGLPDLTKPFELFVDEKQGYAKGVLTQKLGPW

RRPVAYLSKKLDPVAAGWPPCLRMVAAIAVLTKDAGKLTM

GQPLVILAPHAVEALVKQPPDRWLSNARMTHYQALLLDTD

RVQFGPVVALNPATLLPLPEEGLQHNCLDILAEAHGTRPD

LTDQPLPDADHTWYTDGSSLLQEGQRKAGAAVTTETEVIW

AKALPAGTSAQRAELIALTQALKMAEGKKLNVYTDSRYAF

ATAHIHGEIYRRRGWLTSEGKEIKNKDEILALLKALFLPK

RLSIIHCPGHQKGHSAEARGNRMADQAARKAAITETPDTS

TLLIENSSPSGGSKRTADGSEFEKRTADGSEFESPKKKAK

VE
```

Underlining indicates the residue that differs between the nickase and wild-type sequences.

The gene modifying system comprising the gene modifying polypeptides listed above and the template RNA described above were transfected into primary mouse hepatocytes. The gene modifying polypeptide and the template RNA were delivered by nucleofection in the RNA format. Specifically, 4 μg of gene modifying polypeptide mRNA were combined with 10 μg of chemically synthesized template RNA in 5 μL of water. The transfection mix was added to 100,000 mouse primary hepatocytes in Buffer P3 [Lonza], and cells were nucleofected using program DG-138. After nucleofection, cells were grown at 37° C., 5% $CO_2$ for 3 days prior to cell lysis and genomic DNA extraction. To analyze gene editing activity, primers flanking the target insertion site locus were used to amplify across the locus. Amplicons were analyzed via short read sequencing using an Illumina MiSeq. Conversion of terminal A to G sequence in exon 8 of fah gene indicates successful editing.

Figure 2:
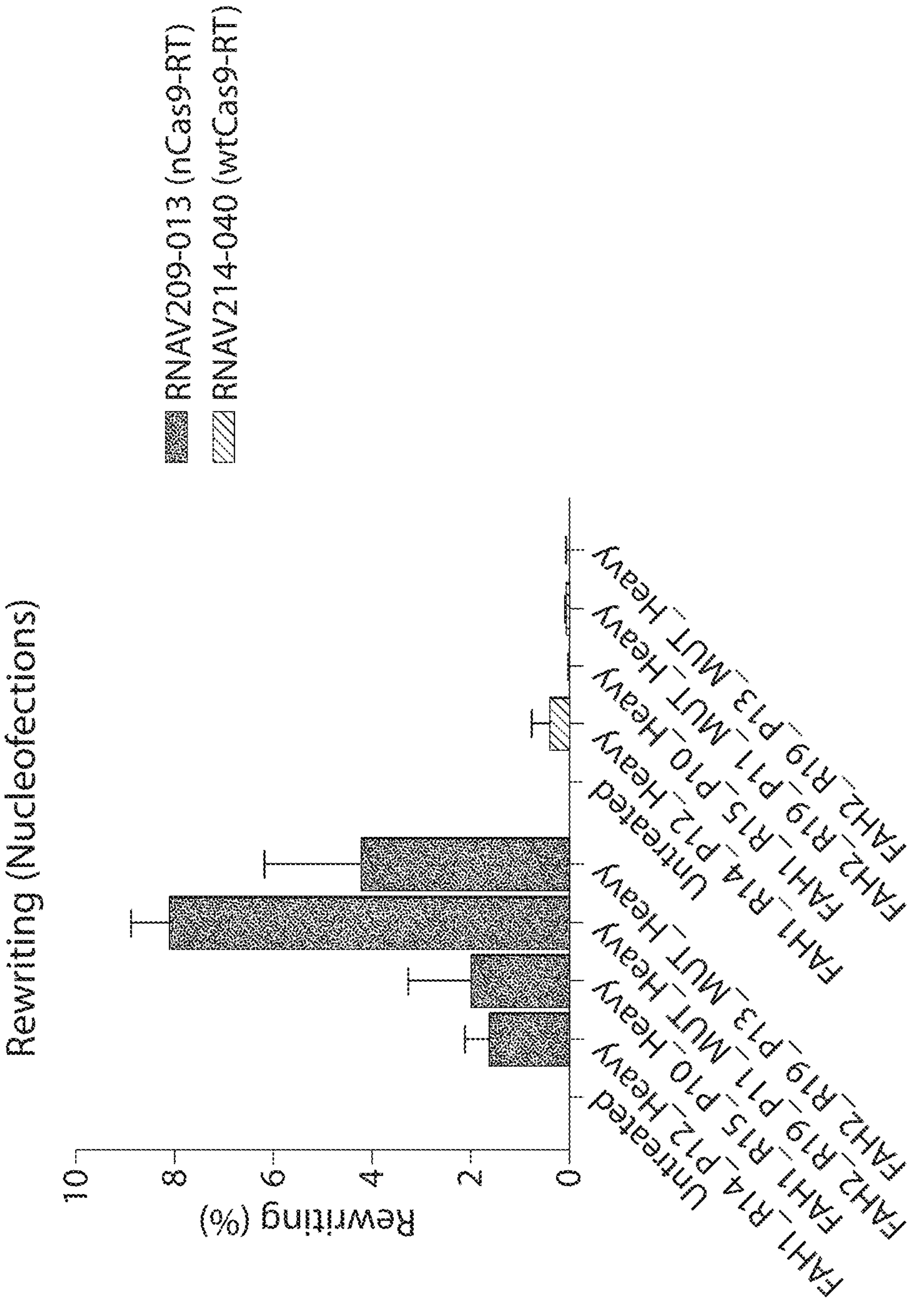
FIG. 2 is a graph showing the percent rewriting achieved using the RNAV209-013 or RNAV214-040 gene modifying polypeptides with the indicated template RNAs.
Figure 3:
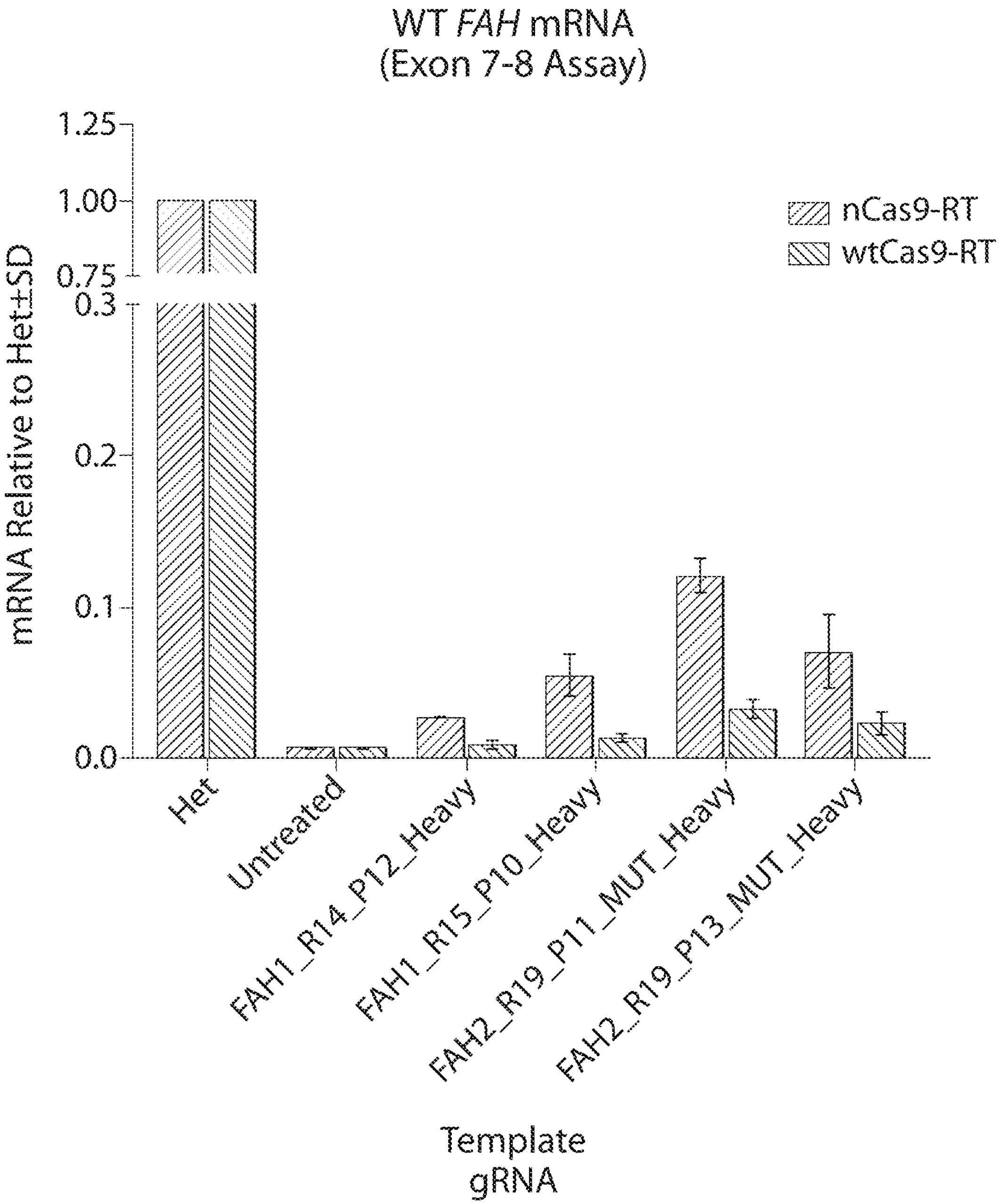
FIG. 3 is a graph showing the amount of Fah mRNA relative to wild type when template RNAs are used with the RNAV209-013 or RNAV214-040 gene modifying polypeptides.

As shown in FIG. 2, for FAH2 templates, perfect rewrite levels (conversion of A to G with no unwanted mutations detected) of 4-8% were detected with RNAV209 but not with RNAV214. Indel levels of 4.4 to 6.6% were observed with RNAV209. Furthermore, the amount of WT Fah mRNA was measured using quantitative RT-PCR using primers that bind to exons 7 and 8. As shown in FIG. 3, FAH2 templates result in an increase in the abundance of Fah mRNA relative to WT by up to 12% when FAH2 template is tested with RNAV209 mRNA. These results demonstrate the use of a gene modifying system to reverse a mutation in the Fah gene, resulting in partial restoration of the expression of wild-type Fah mRNA.

Example 4: Quantifying Activity of a Gene Editing Polypeptide and Template In Vivo for Rewriting the Endogenous FAH Locus Achieved in Mouse Liver This example demonstrates the use of a gene modifying system containing a gene modifying polypeptide and a template RNA, to convert an A nucleotide to a G nucleotide in the Fah5981SB mouse model into the endogenous Fah locus in mouse liver. The Fah5981SB mouse model harbors a G to A point mutation in the last nucleotide of exon 8 of the Fah gene, leading to aberrant mRNA splicing and subsequent mRNA degradation, without the production of Fah protein and serves as a mouse model of hereditary tyrosinemia type I.

In this example, the template RNA contained:

(1) a gRNA spacer;

(2) a gRNA scaffold;

(3) a heterologous object sequence; and (4) a primer binding site (PBS) sequence.

More specifically, the template RNA comprised the following sequences:

```
FAH1_R14_P12_Heavy
RNACS048-001
                                   (SEQ ID NO: 30429)
mG*mG*mA*rUrGrGrUrCrCrUrCrArUrGrArArCrGr

ArCrGrUrUrUrUrArGrAmGmCmUmAmGmAmAmAmUmAm

GmCrArArGrUrUrArArArArUrArArGrGrCrUrArGr

UrCrCrGrUrUrArUrCrAmAmCmUmUmGmAmAmAmAmAm

GmUmGmGmCmAmCmCmGmAmGmUmCmGmGmUmGmCrUrUr

ArCrCrGrCrUrCrCrArGrUrCrGrUrUrCrArUrGrAr

G*mG*mA*mC

FAH1_R15_P10_Heavy
RNACS049-001
                                   (SEQ ID NO: 30430)
mG*mG*mA*rUrGrGrUrCrCrUrCrArUrGrArArCrGr

ArCrGrUrUrUrUrArGrAmGmCmUmAmGmAmAmAmUmAm

GmCrArArGrUrUrArArArArUrArArGrGrCrUrArGr

UrCrCrGrUrUrArUrCrAmAmCmUmUmGmAmAmAmAmAm

GmUmGmGmCmAmCmCmGmAmGmUmCmGmGmUmGmCrArUr

UrArCrCrGrCrUrCrCrArGrUrCrGrUrUrCrArUrG*

mA*mG*mG

FAH2_R19_P11_MUT_Heavy
RNACS052-001
                                    (SEQ ID NO:30431)
mU*mC*mA*rGrArGrGrArArGrCrUrGrGrGrCrCrAr

CrCrGrUrUrUrUrArGrAmGmCmUmAmGmAmAmAmUmAm

GmCrArArGrUrUrArArArArUrArArGrGrCrUrArGr

UrCrCrGrUrUrArUrCrAmAmCmUmUmGmAmAmAmAmAm

GmUmGmGmCmAmCmCmGmAmGmUmCmGmGmUmGmCrUrGr

GrArGrCrGrGrUrArArUrGrGrCrUrGrGrUrGrGrCr

CrCrArGrC*mU*mU*mC
```

-continued

FAH2_R19_P13_MUT_Heavy
RNACS053-001

(SEQ ID NO: 30432)

mU*mC*mA*rGrArGrGrArArGrCrUrGrGrGrCrCrAr CrCrGrUrUrUrArGrAmGmCmUmAmGmAmAmAmUmAm GmCrArArGrUrUrArArArArUrArArGrGrCrUrArGr UrCrCrGrUrUrArUrCrAmAmCmUmUmGmAmAmAmAmAm GmUmGmGmCmAmCmCmGmAmGmUmCmGmGmUmGmCrUrGr GrArGrCrGrGrUrArArUrGrGrCrUrGrGrUrGrGrCr CrCrArGrCrUrU*mC*mC*mU

The gene modifying polypeptides tested comprised a sequence of: RNAV209 and RNAV214, the sequences of which are each provided in Example 3.

Figure 4:
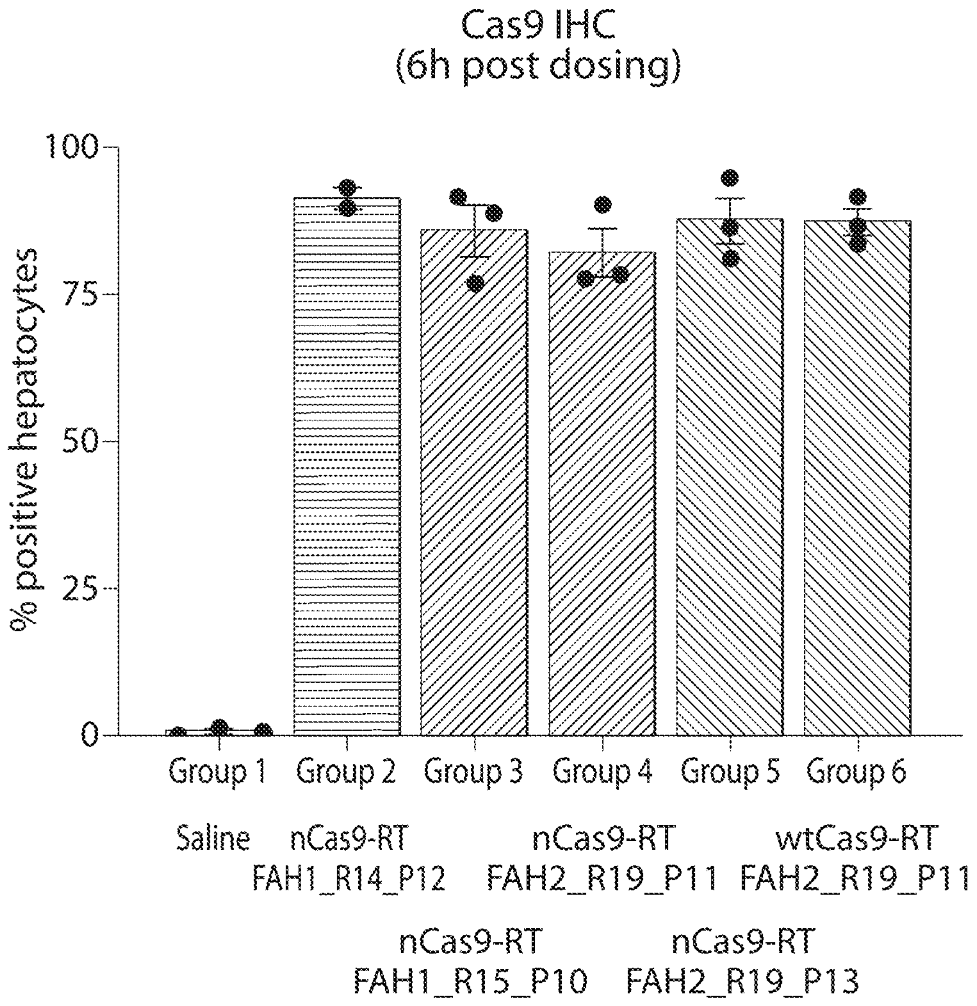
FIG. 4 is a graph showing the percentage of Cas9-positive hepatocytes 6 hours following dosing with LNPs containing various gene modifying polypeptides and template RNAs.

The gene modifying system comprising the gene modifying polypeptides and the template RNA described above was formulated in LNP and delivered to mice. Specifically, 2 mg/kg of total RNA equivalent formulated in LNPs, combined at 1:1 (w/w) of template RNA and mRNA, were dosed intravenously in 7 to 9-week-old, mixed gender Fah5981SB mice. Six hours or 6 days post-dosing, animals were sacrificed, and their liver collected for analyses. To determine the expression distribution of the gene modifying polypeptide in the liver, 6-hr liver samples were subjected to immunohistochemistry using an anti-Cas9 antibody. Upon staining, quantification of Cas9-positive hepatocytes was determined by QuPath Markup. As shown in FIG. 4, the expression of the gene modifying polypeptide was observed in 82-91% of hepatocytes.

Figure 5:
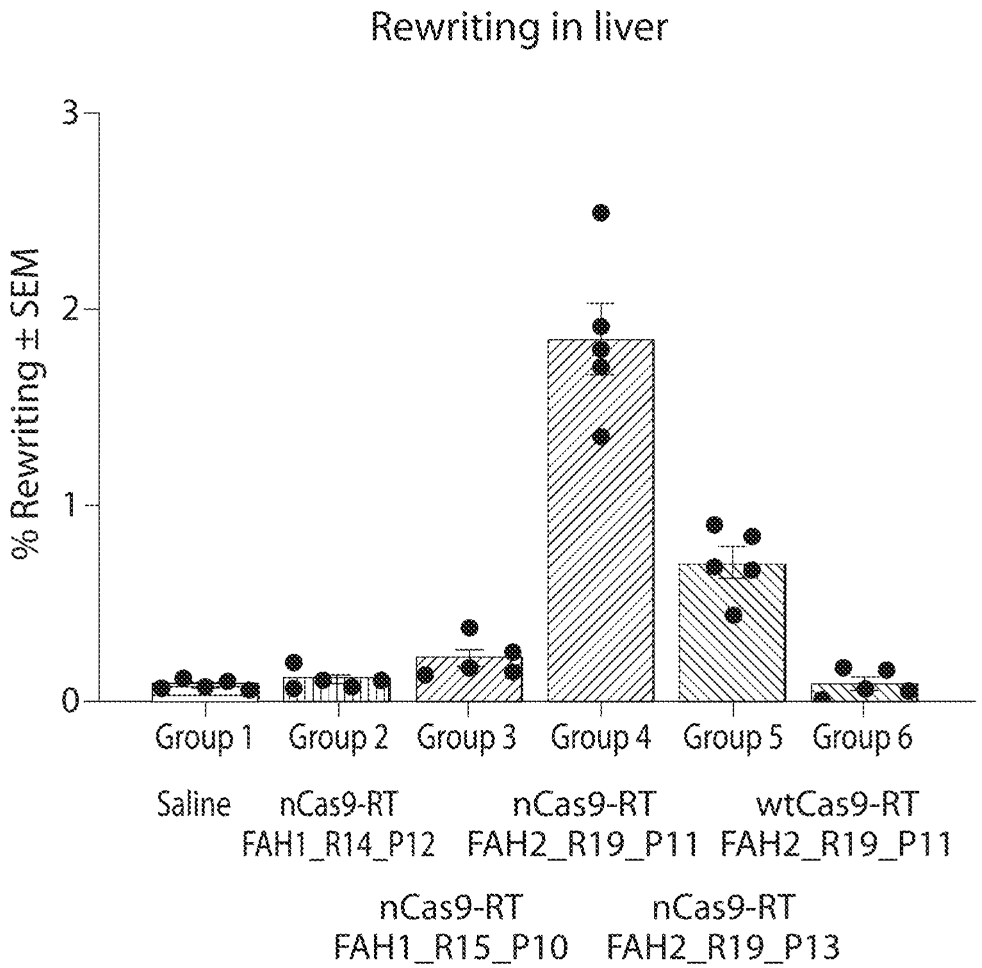
FIG. 5 is a graph showing the rewrite levels in liver samples 6 days following dosing with LNPs containing various gene modifying polypeptides and template RNAs.

To analyze gene editing activity, primers flanking the target insertion site locus were used to amplify across the locus in the genomic DNA of liver samples collected 6 days post-dosing. Amplicons were analyzed via short read sequencing using an Illumina MiSeq. Conversion of an A nucleotide to a G nucleotide indicates successful editing. As shown in FIG. 5, perfect rewrite levels (conversion of A to G with no unwanted mutations detected) of 0.1%-1.9% were detected across the different groups. Indel levels were in the range of 0.2%-0.4%.

Figure 6:
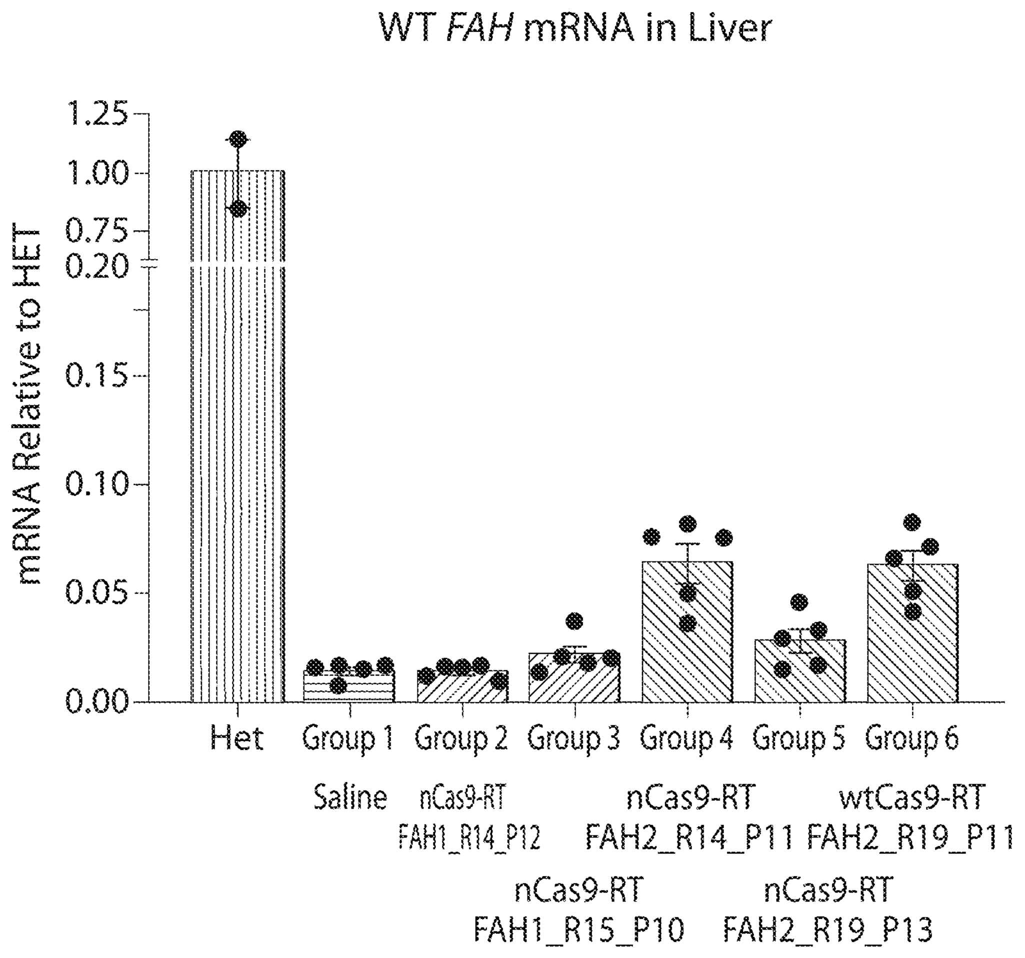
FIG. 6 is a graph showing wild type Fah mRNA restoration compared to littermate heterozygous mice in liver samples following dosing with LNPs containing various gene modifying polypeptides and template RNAs.
Figure 7:
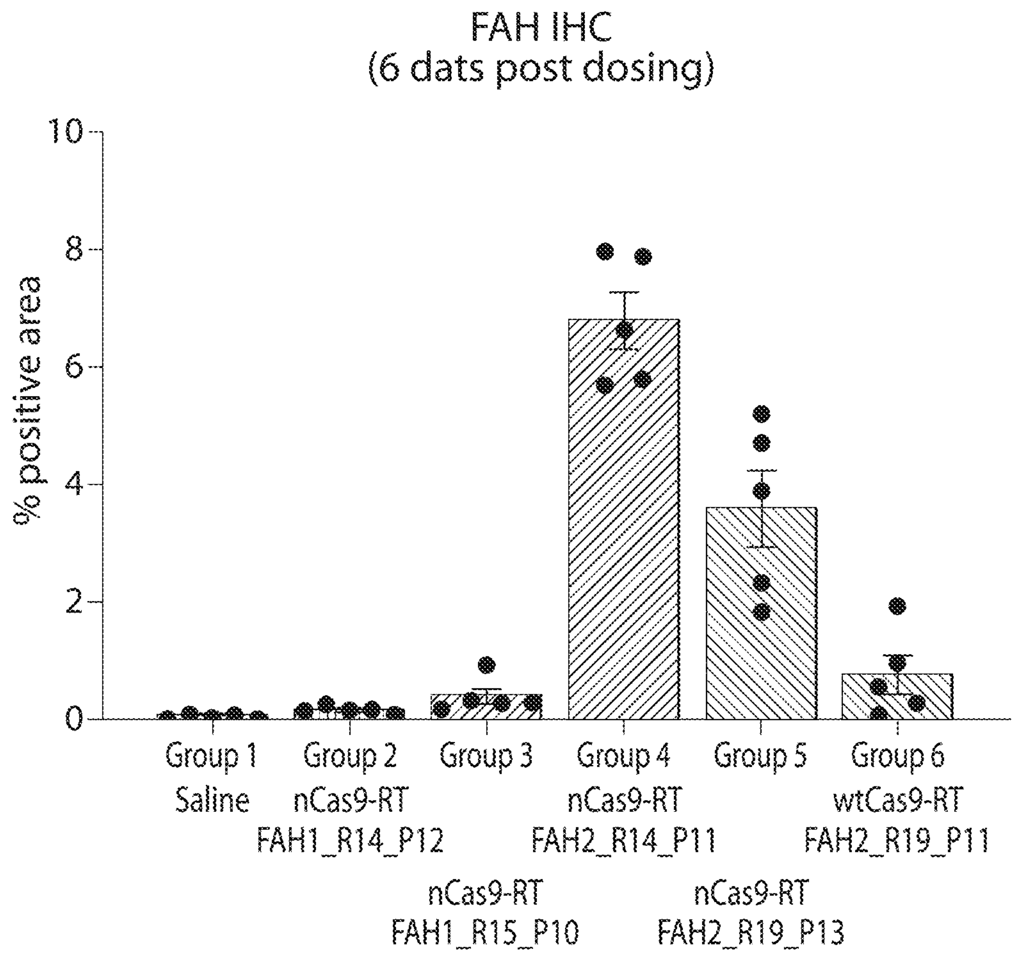
FIG. 7 is a graph showing Fah protein distribution in liver samples following dosing with LNPs containing various gene modifying polypeptides and template RNAs.

To determine the phenotypic correction caused by the gene editing activity, the restoration of wild-type FAH mRNA was determined by real-time qRT-PCR, and the restoration of Fah protein expression determined by immunohistochemistry using an anti-Fah antibody. As shown in FIG. 6, wild-type mRNA restoration of 0.1%-6%, relative to littermate heterozygous mice, was detected across the different groups. As shown in FIG. 7, Fah protein was detected in 0.1%-7% of liver cross-sectional area across the different groups. These results demonstrate the use of a gene modifying system to reverse a mutation in the Fah gene in an in vivo mouse model for hereditary tyrosinemia type I, resulting in partial restoration of expression of wild-type Fah mRNA and Fah protein.

Example 5. Gene Editing at the TTR Locus in an In Vivo Mouse Model

This Example demonstrates successful delivery of an mRNA and guide using Cas9-mediated gene editing using the protospacer sequence ACACAAAUACCAGUCCAGCG (SEQ ID NO: 37641) that targets the TTR locus using a gene modifying polypeptide and RNA in a C57Blk/6 mouse.

RNAs were prepared as follows. An mRNA encoding a gene modifying polypeptide having the sequence shown in Table 5A1 below was produced by in vitro transcription and the purified mRNA was dissolved in 1 mM sodium citrate, pH 6, to a final concentration of RNA of 1-2 mg/mL. Similarly, a guide RNA having a sequence shown in Table 5A1 below was produced by chemical synthesis and dissolved in water or aqueous buffer, to a final concentration of RNA of 1-2 mg/mL.

TABLE 5A1

Sequences of Example 5

| Name | SEQ ID NO | Nucleic acid sequence |
|---|---|---|
| Cas9-RT gene modifying polypeptide | 30433 | AUGCCUGCGGCUAAGCGGGUAAAAU UGGAUGGUGGGGACAAGAAGUACAG CAUCGGCCUGGACAUCGGCACCAAC UCUGUGGGCUGGGCCGUGAUCACCG ACGAGUACAAGGUGCCCAGCAAGAA AUUCAAGGUGCUGGGCAACACCGAC CGGCACAGCAUCAAGAAGAACCUGA UCGGAGCCCUGCUGUUCGACAGCGG CGAAACAGCCGAGGCCACCCGGCUG AAGAGAACCGCCAGAAGAAGAUACA CCAGACGGAAGAACCGGAUCUGCUA UCUGCAAGAGAUCUUCAGCAACGAG AUGGCCAAGGUGGACGACAGCUUCU UCCACAGACUGGAAGAGUCCUUCCU GGUGGAAGAGGAUAAGAAGCACGAG CGGCACCCCAUCUUCGGCAACAUCG UGGACGAGGUGGCCUACCACGAGAA GUACCCCACCAUCUACCACCUGAGA AAGAAACUGGUGGACAGCACCGACA AGGCCGACCUGCGGCUGAUCUAUCU GGCCCUGGCCCACAUGAUCAAGUUC CGGGGCCACUUCCUGAUCGAGGGCG ACCUGAACCCCGACAACAGCGACGU GGACAAGCUGUUCAUCCAGCUGGUG CAGACCUACAACCAGCUGUUCGAGG AAAACCCCAUCAACGCCAGCGGCGU GGACGCCAAGGCCAUCCUGUCUGCC AGACUGAGCAAGAGCAGACGGCUGG AAAAUCUGAUCGCCCAGCUGCCCGG CGAGAAGAAGAAUGGCCUGUUCGGA AACCUGAUUGCCCUGAGCCUGGGCC UGACCCCCAACUUCAAGAGCAACUU CGACCUGGCCGAGGAUGCCAAACUG CAGCUGAGCAAGGACACCUACGACG ACGACCUGGACAACCUGCUGGCCCA GAUCGGCGACCAGUACGCCGACCUG UUUCUGGCCGCCAAGAACCUGUCCG ACGCCAUCCUGCUGAGCGACAUCCU GAGAGUGAACACCGAGAUCACCAAG GCCCCCCUGAGCGCCUCUAUGAUCA AGAGAUACGACGAGCACCACCAGGA CCUGACCCUGCUGAAAGCUCUCGUG CGGCAGCAGCUGCCUGAGAAGUACA AAGAGAUUUUCUUCGACCAGAGCAA GAACGGCUACGCCGGCUACAUUGAC GGCGGAGCCAGCCAGGAAGAGUUCU ACAAGUUCAUCAAGCCCAUCCUGGA AAAGAUGGACGGCACCGAGGAACUG CUCGUGAAGCUGAACAGAGAGGACC UGCUGCGGAAGCAGCGGACCUUCGA CAACGGCAGCAUCCCCCACCAGAUC CACCUGGGAGAGCUGCACGCCAUUC UGCGGCGGCAGGAAGAUUUUUACCC AUUCCUGAAGGACAACCGGGAAAAG AUCGAGAAGAUCCUGACCUUCCGCA UCCCCUACUACGUGGGCCCUCUGGC CAGGGGAAACAGCAGAUUCGCCUGG AUGACCAGAAAGAGCGAGGAAACCA UCACCCCCUGGAACUUCGAGGAAGU GGUGGACAAGGGCGCUUCCGCCCAG AGCUUCAUCGAGCGGAUGACCAACU UCGAUAAGAACCUGCCCAACGAGAA |

TABLE 5A1 -continued

Sequences of Example 5

| Name | SEQ ID NO | Nucleic acid sequence |
|---|---|---|
| | | GGUGCUGCCCAAGCACAGCCUGCUG |
| | | UACGAGUACUUCACCGUGUAUAACG |
| | | AGCUGACCAAAGUGAAAUACGUGAC |
| | | CGAGGGAAUGAGAAAGCCCGCCUUC |
| | | CUGAGCGGCGAGCAGAAAAAGGCCA |
| | | UCGUGGACCUGCUGUUCAAGACCAA |
| | | CCGGAAAGUGACCGUGAAGCAGCUG |
| | | AAAGAGGACUACUUCAAGAAAAUCG |
| | | AGUGCUUCGACUCCGUGGAAAUCUC |
| | | CGGCGUGGAAGAUCGGUUCAACGCC |
| | | UCCCUGGGCACAUACCACGAUCUGC |
| | | UGAAAAUUAUCAAGGACAAGGACUU |
| | | CCUGGACAAUGAGGAAAACGAGGAC |
| | | AUUCUGGAAGAUAUCGUGCUGACCC |
| | | UGACACUGUUUGAGGACAGAGAGAU |
| | | GAUCGAGGAACGGCUGAAAACCUAU |
| | | GCCCACCUGUUCGACGACAAAGUGA |
| | | UGAAGCAGCUGAAGCGGCGGAGAUA |
| | | CACCGGCUGGGGCAGGCUGAGCCGG |
| | | AAGCUGAUCAACGGCAUCCGGGACA |
| | | AGCAGUCCGGCAAGACAAUCCUGGA |
| | | UUUCCUGAAGUCCGACGGCUUCGCC |
| | | AACAGAAACUUCAUGCAGCUGAUCC |
| | | ACGACGACAGCCUGACCUUUAAAGA |
| | | GGACAUCCAGAAAGCCCAGGUGUCC |
| | | GGCCAGGGCGAUAGCCUGCACGAGC |
| | | ACAUUGCCAAUCUGGCCGGCAGCCC |
| | | CGCCAUUAAGAAGGGCAUCCUGCAG |
| | | ACAGUGAAGGUGGUGGACGAGCUCG |
| | | UGAAAGUGAUGGGCCGGCACAAGCC |
| | | CGAGAACAUCGUGAUCGAAAUGGCC |
| | | AGAGAGAACCAGACCACCCAGAAGG |
| | | GACAGAAGAACAGCCGCGAGAGAAU |
| | | GAAGCGGAUCGAAGAGGGCAUCAAA |
| | | GAGCUGGGCAGCCAGAUCCUGAAAG |
| | | AACACCCCGUGGAAAACACCCAGCU |
| | | GCAGAACGAGAAGCUGUACCUGUAC |
| | | UACCUGCAGAAUGGGCGGGAUAUGU |
| | | ACGUGGACCAGGAACUGGACAUCAA |
| | | CCGGCUGUCCGACUACGAUGUGGAC |
| | | CAUAUCGUGCCUCAGAGCUUUCUGA |
| | | AGGACGACUCCAUCGACAACAAGGU |
| | | GCUGACCAGAAGCGACAAGAAUCGG |
| | | GGCAAGAGCGACAACGUGCCCUCCG |
| | | AAGAGGUCGUGAAGAAGAUGAAGAA |
| | | CUACUGGCGGCAGCUGCUGAACGCC |
| | | AAGCUGAUUACCCAGAGAAAGUUCG |
| | | ACAAUCUGACCAAGGCCGAGAGAGG |
| | | CGGCCUGAGCGAACUGGAUAAGGCC |
| | | GGCUUCAUCAAGAGACAGCUGGUGG |
| | | AAACCCGGCAGAUCACAAAGCACGU |
| | | GGCACAGAUCCUGGACUCCCGGAUG |
| | | AACACUAAGUACGACGAGAAUGACA |
| | | AGCUGAUCCGGGAAGUGAAAGUGAU |
| | | CACCCUGAAGUCCAAGCUGGUGUCC |
| | | GAUUUCCGGAAGGAUUUCCAGUUUU |
| | | ACAAAGUGCGCGAGAUCAACAACUA |
| | | CCACCACGCCCACGACGCCUACCUG |
| | | AACGCCGUCGUGGGAACCGCCCUGA |
| | | UCAAAAAGUACCCUAAGCUGGAAAG |
| | | CGAGUUCGUGUACGGCGACUACAAG |
| | | GUGUACGACGUGCGGAAGAUGAUCG |
| | | CCAAGAGCGAGCAGGAAAUCGGCAA |
| | | GGCUACCGCCAAGUACUUCUUCUAC |
| | | AGCAACAUCAUGAACUUUUUCAAGA |
| | | CCGAGAUUACCCUGGCCAACGGCGA |
| | | GAUCCGGAAGCGGCCUCUGAUCGAG |
| | | ACAAACGGCGAAACCGGGGAGAUCG |
| | | UGUGGGAUAAGGGCCGGGAUUUUGC |
| | | CACCGUGCGGAAAGUGCUGAGCAUG |
| | | CCCCAAGUGAAUAUCGUGAAAAAGA |
| | | CCGAGGUGCAGACAGGCGGCUUCAG |
| | | CAAAGAGUCUAUCCUGCCCAAGAGG |
| | | AACAGCGAUAAGCUGAUCGCCAGAA |

TABLE 5A1 -continued

Sequences of Example 5

| Name | SEQ ID NO | Nucleic acid sequence |
|---|---|---|
| | | AGAAGGACUGGGACCCUAAGAAGUA |
| | | CGGCGGCUUCGACAGCCCCACCGUG |
| | | GCCUAUUCUGUGCUGGUGGUGGCCA |
| | | AAGUGGAAAAGGGCAAGUCCAAGAA |
| | | ACUGAAGAGUGUGAAAGAGCUGCUG |
| | | GGGAUCACCAUCAUGGAAAGAAGCA |
| | | GCUUCGAGAAGAAUCCCAUCGACUU |
| | | UCUGGAAGCCAAGGGCUACAAAGAA |
| | | GUGAAAAAGGACCUGAUCAUCAAGC |
| | | UGCCUAAGUACUCCCUGUUCGAGCU |
| | | GGAAAACGGCCGGAAGAGAAUGCUG |
| | | GCCUCUGCCGGCGAACUGCAGAAGG |
| | | GAAACGAACUGGCCCUGCCCUCCAA |
| | | AUAUGUGAACUUCCUGUACCUGGCC |
| | | AGCCACUAUGAGAAGCUGAAGGGCU |
| | | CCCCCGAGGAUAAUGAGCAGAAACA |
| | | GCUGUUUGUGGAACAGCACAAGCAC |
| | | UACCUGGACGAGAUCAUCGAGCAGA |
| | | UCAGCGAGUUCUCCAAGAGAGUGAU |
| | | CCUGGCCGACGCUAAUCUGGACAAA |
| | | GUGCUGUCCGCCUACAACAAGCACC |
| | | GGGAUAAGCCCAUCAGAGAGCAGGC |
| | | CGAGAAUAUCAUCCACCUGUUUACC |
| | | CUGACCAAUCUGGGAGCCCCUGCCG |
| | | CCUUCAAGUACUUUGACACCACCAU |
| | | CGACCGGAAGAGGUACACCAGCACC |
| | | AAAGAGGUGCUGGACGCCACCCUGA |
| | | UCCACCAGAGCAUCACCGGCCUGUA |
| | | CGAGACACGGAUCGACCUGUCUCAG |
| | | CUGGGAGGUGACUCUGGAGGAUCUA |
| | | GCGGAGGAUCCUCUGGCAGCGAGAC |
| | | ACCAGGAACAAGCGAGUCAGCAACA |
| | | CCAGAGAGCAGUGGCGGCAGCAGCG |
| | | GCGGCAGCAGCACCCUAAAUAUAGA |
| | | AGAUGAGUAUCGGCUACAUGAGACC |
| | | UCAAAAGAGCCAGAUGUUUCUCUAG |
| | | GGUCCACAUGGCUGUCUGAUUUUCC |
| | | UCAGGCCUGGGCGGAAACCGGGGGC |
| | | AUGGGACUGGCAGUUCGCCAAGCUC |
| | | CUCUGAUCAUACCUCUGAAAGCAAC |
| | | CUCUACCCCCGUGUCCAUAAAACAA |
| | | UACCCCAUGUCACAAGAAGCCAGAC |
| | | UGGGGAUCAAGCCCCACAUACAGAG |
| | | ACUGUUGGACCAGGGAAUACUGGUA |
| | | CCCUGCCAGUCCCCCUGGAACACGC |
| | | CCCUGCUACCCGUUAAGAAACCAGG |
| | | GACUAAUGAUUAUAGGCCUGUCCAG |
| | | GAUCUGAGAGAAGUCAACAAGCGGG |
| | | UGGAGGACAUCCACCCCACCGUGCC |
| | | CAACCCUUACAACCUCUUGAGCGGG |
| | | CUCCCACCGUCCCACCAGUGGUACA |
| | | CUGUGCUUGAUUUAAAGGAUGCCUU |
| | | UUUCUGCCUGAGACUCCACCCCACC |
| | | AGUCAGCCUCUCUUCGCCUUUGAGU |
| | | GGAGAGAUCCAGAGAUGGGAAUCUC |
| | | AGGACAAUUGACCUGGACCAGACUC |
| | | CCACAGGGUUUCAAAAACAGUCCCA |
| | | CCCUGUUUAAUGAGGCACUGCACAG |
| | | AGACCUAGCAGACUUCCGGAUCCAG |
| | | CACCCAGACUUGAUCCUGCUACAGU |
| | | ACGUGGAUGACUUACUGCUGGCCGC |
| | | CACUUCUGAGCUAGACUGCCAACAA |
| | | GGUACUCGGGCCCUGUUACAAACCC |
| | | UAGGGAACCUCGGGUAUCGGGCCUC |
| | | GGCCAAGAAAGCCCAAAUUUGCCAG |
| | | AAACAGGUCAAGUAUCUGGGGUAUC |
| | | UUCUAAAAGAGGGUCAGAGAUGGCU |
| | | GACUGAGGCCAGAAAAGAGACUGUG |
| | | AUGGGGCAGCCUACUCCGAAGACCC |
| | | CUCGACAACUAAGGGAGUUCCUAGG |
| | | GAAGGCAGGCUUCUGUCGCCUCUUC |
| | | AUCCCUGGGUUUGCAGAAAUGGCAG |
| | | CCCCCCUGUACCCUCUCACCAAACC |
| | | GGGGACUCUGUUUAAUUGGGGCCCA |

TABLE 5A1 -continued

| Sequences of Example 5 | | |
|---|---|---|
| Name | SEQ ID NO | Nucleic acid sequence |
| | | GACCAACAAAAGGCCUAUCAAGAAA<br>UCAAGCAAGCCCUUCUAACUGCCCC<br>AGCCCUGGGGUUGCCAGAUUUGACU<br>AAGCCCUUUGAACUCUUUGUCGACG<br>AGAAGCAGGGCUACGCCAAAGGUGU<br>CCUAACGCAAAAACUGGGACCUUGG<br>CGUCGGCCGGUGGCCUACCUGUCCA<br>AAAAGCUAGACCCAGUAGCAGCUGG<br>GUGGCCCCCUUGCCUACGGAUGGUA<br>GCAGCCAUUGCCGUACUGACAAAGG<br>AUGCAGGCAAGCUAACCAUGGGACA<br>GCCACUAGUCAUUCUGGCCCCCCAU<br>GCAGUAGAGGCACUAGUCAAACAAC<br>CCCCCGACCGCUGGCUUUCCAACGC<br>CCGGAUGACUCACUAUCAGGCCUUG<br>CUUUUGGACACGGACCGGGUCCAGU<br>UCGGACCGGUGGUAGCCCUGAACCC<br>GGCUACGCUGCUCCCACUGCCUGAG<br>GAAGGGCUGCAACACAACUGCCUUG<br>AUAUCCUGGCCGAAGCCCACGGAAC<br>CCGACCCGACCUAACGGACCAGCCG<br>CUCCCAGACGCCGACCACACCUGGU<br>ACACGGAUGGAAGCAGUCUCUUACA<br>AGAGGGACAGCGUAAGGCGGGAGCU<br>GCGGUGACCACCGAGACCGAGGUAA<br>UCUGGGCUAAAGCCCUGCCAGCCGG<br>GACAUCCGCUCAGCGGGCUGAACUG<br>AUAGCACUCACCCAGGCCCUAAAGA<br>UGGCAGAAGGUAAGAAGCUAAAUGU<br>UUAUACUGAUAGCCGUUAUGCUUUU<br>GCUACUGCCCAUAUCCAUGGAGAAA<br>UAUACAGAAGGCGUGGGUGGCUCAC<br>AUCAGAAGGCAAAGAGAUCAAAAAU<br>AAAGACGAGAUCUUGGCCCUACUAA<br>AAGCCCUCUUUCUGCCCAAAAGACU<br>UAGCAUAAUCCAUUGUCCAGGACAU<br>CAAAAGGGACACAGCGCCGAGGCUA<br>GAGGCAACCGGAUGGCUGACCAAGC<br>GGCCCGAAAGGCAGCCAUCACAGAG<br>ACUCCAGACACCUCUACCCUCCUCA<br>UAGAAAAUUCAUCACCCUCUGGCGG<br>CUCAAAAAGAACCGCCGACGGCAGC<br>GAAUUCGAGAAAAGGACGGCGGAUG<br>GUAGCGAAUUCGAGAGCCCUAAAAA<br>GAAGGCCAAGGUAGAGUAA |
| guide RNA | 30434 | mA*mC*mA*CAAAUACCAGUCCAGC<br>GGUUUUAGAmGmCmUmAmGmAmAmA<br>mUmAmGmCAAGUUAAAAUAAGGCUA<br>GUCCGUUAUCAmAmCmUmUmGmAmA<br>mAmAmAmGmUmGmGmCmAmCmCmGm<br>AmGmUmCmGmGmUmGmCmU*mU*mU<br>*mU |

m = 2'OMethyl,
*= phosphorothioate linkage

Lipid nanoparticle (LNP) components (ionizable lipid, helper lipid, sterol, PEG) were dissolved in 100% ethanol with the lipid component molar ratios of 47:8:43.5:1.5, respectively. RNA (guide and mRNA) was combined in a 1:1 weight ratio and diluted to a concentration of 0.05-0.2 mg/mL in sodium acetate buffer, pH 5. RNA was formulated into distinct LNPs with a lipid amine to total RNA phosphate (N:P) molar ratio of 4.0. The LNPs were formed by microfluidic or turbulent mixing of the lipid and RNA solutions. A 3:1 ratio of aqueous to organic solvent was maintained during mixing using differential flow rates. After mixing, the LNPs were diluted, collected and buffer exchanged into 50 mM Tris, 9% sucrose buffer using tangential flow filtration. Formulations were concentrated to 1.0 mg/mL or higher then filtered through 0.2 μm sterile filter. The final LNP were stored at −80° C. until further use.

Figure 8:
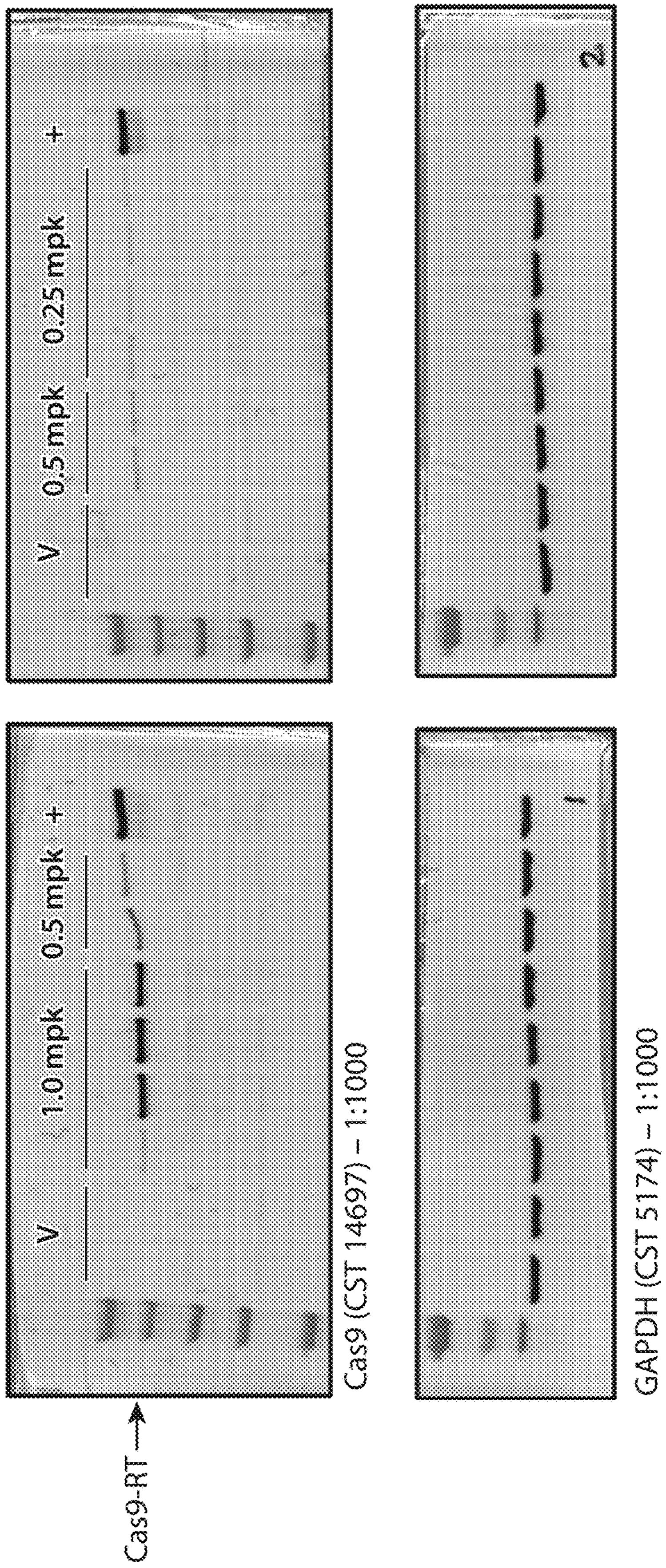
FIG. 8 is a series of western blots showing Cas9-RT Expression 6 hours after infusion of Cas9-RT mRNA+TTR guide LNP. Each lane represents an individual animal where 20 μg of tissue homogenate was added per lane. Positive control was from an in vitro cell experiment where Cas9-RT was expressed (described previously). GAPDH was used as a loading control for each sample. n=4 per group, vehicle or treated.
Figure 9:
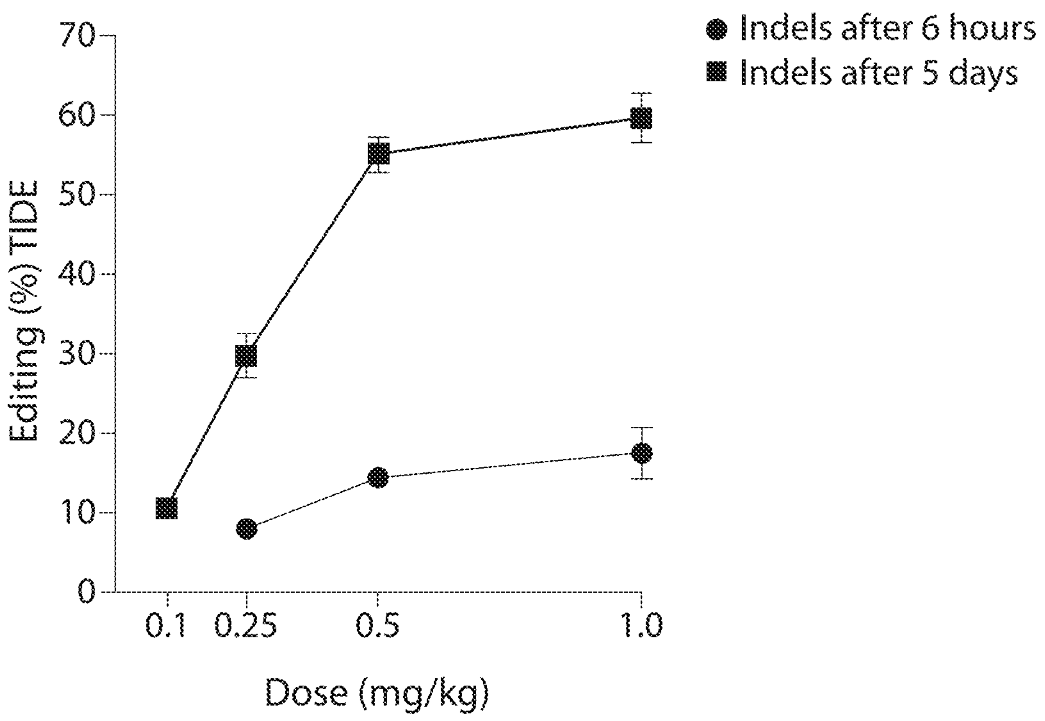
FIG. 9 is a graph showing gene editing of TTR locus after treatment with Cas9-RT mRNA+TTR guide LNP. Level of indels detected at the TTR locus measured by TIDE analysis of Sanger sequencing of the TTR locus where the protospacer targets.
Figure 10:
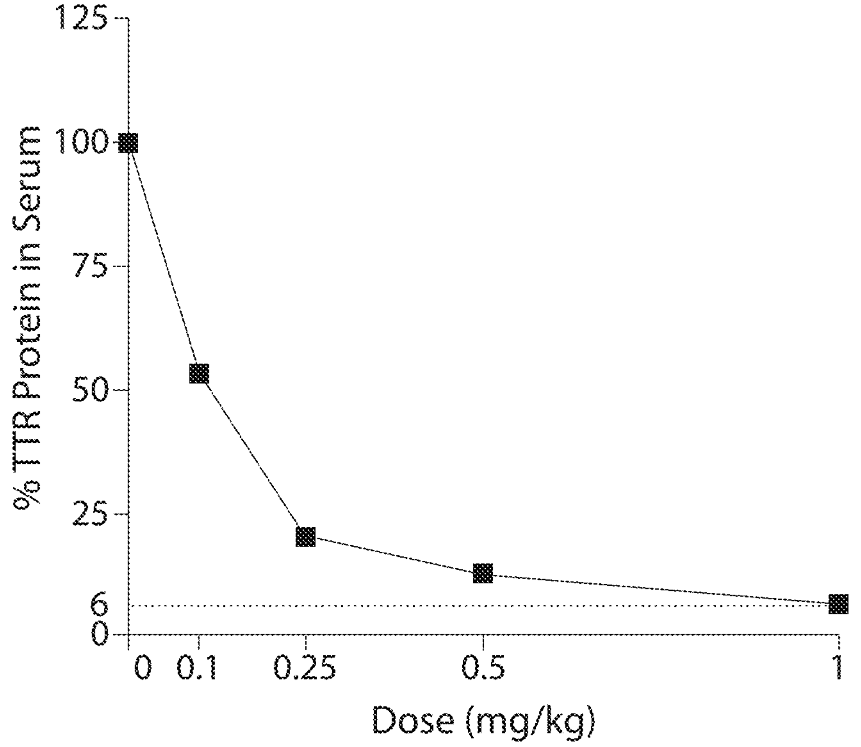
FIG. 10 is a graph showing that TTR Serum levels decrease after treatment with Cas9-RT mRNA+TTR guide LNP. Measurement of circulating TTR levels 5 days after mice were treated with LNPs encapsulating Cas9-RT+TTR guide RNA.

The LNP formulations were delivered intravenously by bolus tail vein injection to C57Blk/6 mice that were approximately 8 weeks old at concentrations ranging from 1-0.1 mg/kg. The expression of the Cas9-RT was measured by 6 hours after injection by euthanizing animals and collecting livers during necropsy. Animals were euthanized at 5 days after injection where liver was collected upon necropsy to which the activity of gene editing of the TTR locus was assessed. Expression of the Cas9-RT gene editing polypeptide in liver was measured by Western blot where Cas9 was detected by a mouse monoclonal antibody (7A9-3A3, Cell Signaling Technology) and GAPDH (Cell Signaling Technology) was used as a loading control. (FIG. 8). Editing of the TTR locus was quantified by Sanger sequencing followed by TIDE analysis of an amplicon of the TTR locus near the binding site of the protospacer. Editing of the TTR locus was observed, as shown in FIG. 9. TTR protein levels in serum were quantified by an ELISA using a standard curve (Aviva Biosciences). TTR protein levels in serum declined in treated animals, as shown in FIG. 10. These experiments demonstrate that the Cas9-RT polypeptide can be expressed in vivo, and can edit the TTR locus, resulting in a decrease in TTR protein levels in serum.

Example 6. Gene Editing at the TTR Locus in an In Vivo Cynomolgus Macaque Model This Example demonstrates successful delivery of an mRNA and guide using Cas9-mediated gene editing using the protospacer sequence ACACAAAUACCAGUCCAGCG (SEQ ID NO: 37641) that targets the TTR locus using a gene modifying polypeptide and RNA in a cynomolgus model.

RNAs were prepared as follows. An mRNA encoding a gene modifying polypeptide having the sequence shown in Table 6A1 below was produced by in vitro transcription and the purified mRNA was dissolved in 1 mM sodium citrate, pH 6, to a final concentration of RNA of 1-2 mg/mL. Similarly, a guide RNA having a sequence shown in Table 6A1 below was produced by chemical synthesis and dissolved in water or aqueous buffer, to a final concentration of RNA of 1-2 mg/mL.

TABLE 6A1

| Sequences of Example 6 | | |
|---|---|---|
| Name | SEQ ID NO | Nucleic acid sequence |
| Cas9-RT gene modifying polypeptide | 30435 | AUGCCUGCGGCUAAGCGGGUAAAAUUGGAUGGUGGGGACAAGAAGUA<br>CAGCAUCGGCCUGGACAUCGGCACCAACUCUGUGGGCUGGGCCGUGAU<br>CACCGACGAGUACAAGGUGCCCAGCAAGAAAUUCAAGGUGCUGGGCAA<br>CACCGACCGGCACAGCAUCAAGAAGAACCUGAUCGGAGCCCUGCUGUU<br>CGACAGCGGCGAAACAGCCGAGGCCACCCGGCUGAAGAGAACCGCCAG<br>AAGAAGAUACACCAGACGGAAGAACCGGAUCUGCUAUCUGCAAGAGAU |

TABLE 6A1-continued

| Sequences of Example 6 | | |
|---|---|---|
| Name | SEQ ID NO | Nucleic acid sequence |
| | | CUUCAGCAACGAGAUGGCCAAGGUGGACGACAGCUUCUUCCACAGACU<br>GGAAGAGUCCUUCCUGGUGGAAGAGGAUAAGAAGCACGAGCGGCACCC<br>CAUCUUCGGCAACAUCGUGGACGAGGUGGCCUACCACGAGAAGUACCC<br>CACCAUCUACCACCUGAGAAAGAAACUGGUGGACAGCACCGACAAGGC<br>CGACCUGCGGCUGAUCUAUCUGGCCCUGGCCCACAUGAUCAAGUUCCG<br>GGGCCACUUCCUGAUCGAGGGCGACCUGAACCCCGACAACAGCGACGU<br>GGACAAGCUGUUCAUCCAGCUGGUGCAGACCUACAACCAGCUGUUCGA<br>GGAAAACCCCAUCAACGCCAGCGGCGUGGACGCCAAGGCCAUCCUGUC<br>UGCCAGACUGAGCAAGAGCAGACGGCUGGAAAAUCUGAUCGCCCAGCU<br>GCCCGGCGAGAAGAAGAAUGGCCUGUUCGGAAACCUGAUUGCCCUGAG<br>CCUGGGCCUGACCCCCAACUUCAAGAGCAACUUCGACCUGGCCGAGGA<br>UGCCAAACUGCAGCUGAGCAAGGACACCUACGACGACGACCUGGACAA<br>CCUGCUGGCCCAGAUCGGCGACCAGUACGCCGACCUGUUUCUGGCCGC<br>CAAGAACCUGUCCGACGCCAUCCUGCUGAGCGACAUCCUGAGAGUGAA<br>CACCGAGAUCACCAAGGCCCCCCUGAGCGCCUCUAUGAUCAAGAGAUA<br>CGACGAGCACCACCAGGACCUGACCCUGCUGAAAGCUCUCGUGCGGCA<br>GCAGCUGCCUGAGAAGUACAAAGAGAUUUUCUUCGACCAGAGCAAGAA<br>CGGCUACGCCGGCUACAUUGACGGCGGAGCCAGCCAGGAAGAGUUCUA<br>CAAGUUCAUCAAGCCCAUCCUGGAAAAGAUGGACGGCACCGAGGAACU<br>GCUCGUGAAGCUGAACAGAGAGGACCUGCUGCGGAAGCAGCGGACCUU<br>CGACAACGGCAGCAUCCCCCACCAGAUCCACCUGGGAGAGCUGCACGC<br>CAUUCUGCGGCGGCAGGAAGAUUUUUACCCAUUCCUGAAGGACAACCG<br>GGAAAAGAUCGAGAAGAUCCUGACCUUCCGCAUCCCCUACUACGUGGG<br>CCCUCUGGCCAGGGGAAACAGCAGAUUCGCCUGGAUGACCAGAAAGAG<br>CGAGGAAACCAUCACCCCCUGGAACUUCGAGGAAGUGGUGGACAAGGG<br>CGCUUCCGCCCAGAGCUUCAUCGAGCGGAUGACCAACUUCGAUAAGAA<br>CCUGCCCAACGAGAAGGUGCUGCCCAAGCACAGCCUGCUGUACGAGUA<br>CUUCACCGUGUAUAACGAGCUGACCAAAGUGAAAUACGUGACCGAGGG<br>AAUGAGAAAGCCCGCCUUCCUGAGCGGCGAGCAGAAAAAGGCCAUCGU<br>GGACCUGCUGUUCAAGACCAACCGGAAAGUGACCGUGAAGCAGCUGAA<br>AGAGGACUACUUCAAGAAAAUCGAGUGCUUCGACUCCGUGGAAAUCUC<br>CGGCGUGGAAGAUCGGUUCAACGCCUCCCUGGGCACAUACCACGAUCU<br>GCUGAAAAUUAUCAAGGACAAGGACUUCCUGGACAAUGAGGAAAACG<br>AGGACAUUCUGGAAGAUAUCGUGCUGACCCUGACACUGUUUGAGGACA<br>GAGAGAUGAUCGAGGAACGGCUGAAAACCUAUGCCCACCUGUUCGACG<br>ACAAAGUGAUGAAGCAGCUGAAGCGGCGGAGAUACACCGGCUGGGGCA<br>GGCUGAGCCGGAAGCUGAUCAACGGCAUCCGGGACAAGCAGUCCGGCA<br>AGACAAUCCUGGAUUUCCUGAAGUCCGACGGCUUCGCCAACAGAAACU<br>UCAUGCAGCUGAUCCACGACGACAGCCUGACCUUUAAAGAGGACAUCC<br>AGAAAGCCCAGGUGUCCGGCCAGGGCGAUAGCCUGCACGAGCACAUUG<br>CCAAUCUGGCCGGCAGCCCCGCCAUUAAGAAGGGCAUCCUGCAGACAG<br>UGAAGGUGGUGGACGAGCUCGUGAAAGUGAUGGGCCGGCACAAGCCCG<br>AGAACAUCGUGAUCGAAAUGGCCAGAGAGAACCAGACCACCCAGAAGG<br>GACAGAAGAACAGCCGCGAGAGAAUGAAGCGGAUCGAAGAGGGCAUCA<br>AAGAGCUGGGCAGCCAGAUCCUGAAAGAACACCCCGUGGAAAACACCC<br>AGCUGCAGAACGAGAAGCUGUACCUGUACUACCUGCAGAAUGGGGGG<br>AUAUGUACGUGGACCAGGAACUGGACAUCAACCGGCUGUCCGACUACG<br>AUGUGGACCAUAUCGUGCCUCAGAGCUUUCUGAAGGACGACUCCAUCG<br>ACAACAAGGUGCUGACCAGAAGCGACAAGAAUCGGGGCAAGAGCGACA<br>ACGUGCCCUCCGAAGAGGUCGUGAAGAAGAUGAAGAACUACUGGCGGC<br>AGCUGCUGAACGCCAAGCUGAUUACCCAGAGAAAGUUCGACAAUCUGA<br>CCAAGGCCGAGAGAGGCGGCCUGAGCGAACUGGAUAAGGCCGGCUUCA<br>UCAAGAGACAGCUGGUGGAAACCCGGCAGAUCACAAAGCACGUGGCAC<br>AGAUCCUGGACUCCCGGAUGAACACUAAGUACGACGAGAAUGACAAGC<br>UGAUCCGGGAAGUGAAAGUGAUCACCCUGAAGUCCAAGCUGGUGUCCG<br>AUUUCCGGAAGGAUUUCCAGUUUUACAAAGUGCGCGAGAUCAACAACU<br>ACCACCACGCCCACGACGCCUACCUGAACGCCGUCGUGGGAACCGCCCU<br>GAUCAAAAAGUACCCUAAGCUGGAAAGCGAGUUCGUGUACGGCGACUA<br>CAAGGUGUACGACGUGCGGAAGAUGAUCGCCAAGAGCGAGCAGGAAAU<br>CGGCAAGGCUACCGCCAAGUACUUCUUCUACAGCAACAUCAUGAACUU<br>UUUCAAGACCGAGAUUACCCUGGCCAACGGCGAGAUCCGGAAGCGGCC<br>UCUGAUCGAGACAAACGGCGAAACCGGGGAGAUCGUGUGGGAUAAGG<br>GCCGGGAUUUUGCCACCGUGCGGAAAGUGCUGAGCAUGCCCCAAGUGA<br>AUAUCGUGAAAAAGACCGAGGUGCAGACAGGCGGCUUCAGCAAAGAGU<br>CUAUCCUGCCCAAGAGGAACAGCGAUAAGCUGAUCGCCAGAAAGAAGG<br>ACUGGGACCCUAAGAAGUACGGCGGCUUCGACAGCCCCACCGUGGCCU<br>AUUCUGUGCUGGUGGUGGCCAAAGUGGAAAAGGGCAAGUCCAAGAAA<br>CUGAAGAGUGUGAAAGAGCUGCUGGGGAUCACCAUCAUGGAAAGAAG<br>CAGCUUCGAGAAGAAUCCCAUCGACUUUCUGGAAGCCAAGGGCUACAA<br>AGAAGUGAAAAAGGACCUGAUCAUCAAGCUGCCUAAGUACUCCCUGUU<br>CGAGCUGGAAAACGGCCGGAAGAGAAUGCUGGCCUCUGCCGGCGAACU<br>GCAGAAGGGAAACGAACUGGCCCUGCCCUCCAAAUAUGUGAACUUCCU<br>GUACCUGGCCAGCCACUAUGAGAAGCUGAAGGGCUCCCCCGAGGAUAA<br>UGAGCAGAAACAGCUGUUUGUGGAACAGCACAAGCACUACCUGGACGA<br>GAUCAUCGAGCAGAUCAGCGAGUUCUCCAAGAGAGUGAUCCUGGCCGA<br>CGCUAAUCUGGACAAAGUGCUGUCCGCCUACAACAAGCACCGGGAUAA |

TABLE 6A1-continued

| Name | SEQ ID NO | Nucleic acid sequence |
|---|---|---|
| | | Sequences of Example 6 |
| | | GCCCAUCAGAGAGCAGGCCGAGAAUAUCAUCCACCUGUUUACCCUGAC CAAUCUGGGAGCCCCUGCCGCCUUCAAGUACUUUGACACCACCAUCGA CCGGAAGAGGUACACCAGCACCAAAGAGGUGCUGGACGCCACCCUGAU CCACCAGAGCAUCACCGGCCUGUACGAGACACGGAUCGACCUGUCUCA GCUGGGAGGUGACUCUGGAGGAUCUAGCGGAGGAUCCUCUGGCAGCGA GACACCAGGAACAAGCGAGUCAGCAACACCAGAGAGCAGUGGCGGCAG CAGCGGCGGCAGCAGCACCCUAAAUAUAGAAGAUGAGUAUCGGCUACA UGAGACCUCAAAAGAGCCAGAUGUUUCUCUAGGGUCCACAUGGCUGUC UGAUUUUCCUCAGGCCUGGGCGGAAACCGGGGGCAUGGGACUGGCAGU UCGCCAAGCUCCUCUGAUCAUACCUCUGAAAGCAACCUCUACCCCCGU GUCCAUAAAACAAUACCCCAUGUCACAAGAAGCCAGACUGGGGAUCAA GCCCCACAUACAGAGACUGUUGGACCAGGGAAUACUGGUACCCUGCCA GUCCCCCUGGAACACGCCCCUGCUACCCGUUAAGAAACCAGGGACUAA UGAUUAUAGGCCUGUCCAGGAUCUGAGAGAAGUCAACAAGCGGGUGG AGGACAUCCACCCCACCGUGCCCAACCCUUACAACCUCUUGAGCGGGC UCCCACCGUCCCACCAGUGGUACACUGUGCUUGAUUUAAAGGAUGCCU UUUUCUGCCUGAGACUCCACCCCACCAGUCAGCCUCUCUUCGCCUUUG AGUGGAGAGAUCCAGAGAUGGGAAUCUCAGGACAAUUGACCUGGACCA GACUCCCACAGGGUUUCAAAAACAGUCCCACCCUGUUUAAUGAGGCAC UGCACAGAGACCUAGCAGACUUCCGGAUCCAGCACCCAGACUUGAUCC UGCUACAGUACGUGGAUGACUUACUGCUGGCCGCCACUUCUGAGCUAG ACUGCCAACAAGGUACUCGGGCCCUGUUACAAACCCUAGGGAACCUCG GGUAUCGGGCCUCGGCCAAGAAAGCCCAAAUUUGCCAGAAACAGGUCA AGUAUCUGGGGUAUCUUCUAAAAGAGGGUCAGAGAUGGCUGACUGAG GCCAGAAAAGAGACUGUGAUGGGGCAGCCUACUCCGAAGACCCCUCGA CAACUAAGGGAGUUCCUAGGGAAGGCAGGCUUCUGUCGCCUCUUCAUC CCUGGGUUUGCAGAAAUGGCAGCCCCCCUGUACCCUCUCACCAAACCG GGGACUCUGUUUAAUUGGGGCCCAGACCAACAAAAGGCCUAUCAAGAA AUCAAGCAAGCCCUUCUAACUGCCCCAGCCCUGGGGUUGCCAGAUUUG ACUAAGCCCUUUGAACUCUUUGUCGACGAGAAGCAGGGCUACGCCAAA GGUGUCCUAACGCAAAAACUGGGACCUUGGCGUCGGCCGGUGGCCUAC CUGUCCAAAAAGCUAGACCCAGUAGCAGCUGGGUGGCCCCCUUGCCUA CGGAUGGUAGCAGCCAUUGCCGUACUGACAAAGGAUGCAGGCAAGCUA ACCAUGGGACAGCCACUAGUCAUUCUGGCCCCCCAUGCAGUAGAGGCA CUAGUCAAACAACCCCCCGACCGCUGGCUUUCCAACGCCCGGAUGACU CACUAUCAGGCCUUGCUUUUGGACACGGACCGGGUCCAGUUCGGACCG GUGGUAGCCCUGAACCCGGCUACGCUGCUCCCACUGCCUGAGGAAGGG CUGCAACACAACUGCCUUGAUAUCCUGGCCGAAGCCCACGGAACCCGA CCCGACCUAACGGACCAGCCGCUCCCAGACGCCGACCACACCUGGUACA CGGAUGGAAGCAGUCUCUUACAAGAGGGACAGCGUAAGGCGGGAGCUG CGGUGACCACCGAGACCGAGGUAAUCUGGGCUAAAGCCCUGCCAGCCG GGACAUCCGCUCAGCGGGCUGAACUGAUAGCACUCACCCAGGCCCUAA AGAUGGCAGAAGGUAAGAAGCUAAAUGUUUAUACUGAUAGCCGUUAU GCUUUUGCUACUGCCCAUAUCCAUGGAGAAAUAUACAGAAGGCGUGGG UGGCUCACAUCAGAAGGCAAAGAGAUCAAAAAUAAAGACGAGAUCUU GGCCCUACUAAAAGCCCUCUUUCUGCCCAAAAGACUUAGCAUAAUCCA UUGUCCAGGACAUCAAAAGGGACACAGCGCCGAGGCUAGAGGCAACCG GAUGGCUGACCAAGCGGCCCGAAAGGCAGCCAUCACAGAGACUCCAGA CACCUCUACCCUCCUCAUAGAAAAUUCAUCACCCUCUGGCGGCUCAAA AAGAACCGCCGACGGCAGCGAAUUCGAGAAAAGGACGGCGGAUGGUAG CGAAUUCGAGAGCCCUAAAAAGAAGGCCAAGGUAGAGUAA |
| guide RNA | 30436 | mA*mC*mA*CAAAUACCAGUCCAGCGGUUUUAGAmGmCmUmAmGmAmA mAmUmAmGmCAAGUUAAAAUAAGGCUAGUCCGUUAUCAmAmCmUmUm GmAmAmAmAmAmGmUmGmGmCmAmCmCmGmAmGmUmCmGmGmUmG mCmU*mU*mU*mU |

m = 2'OMethyl, * = phosphorothioate linkage

Figure 11:
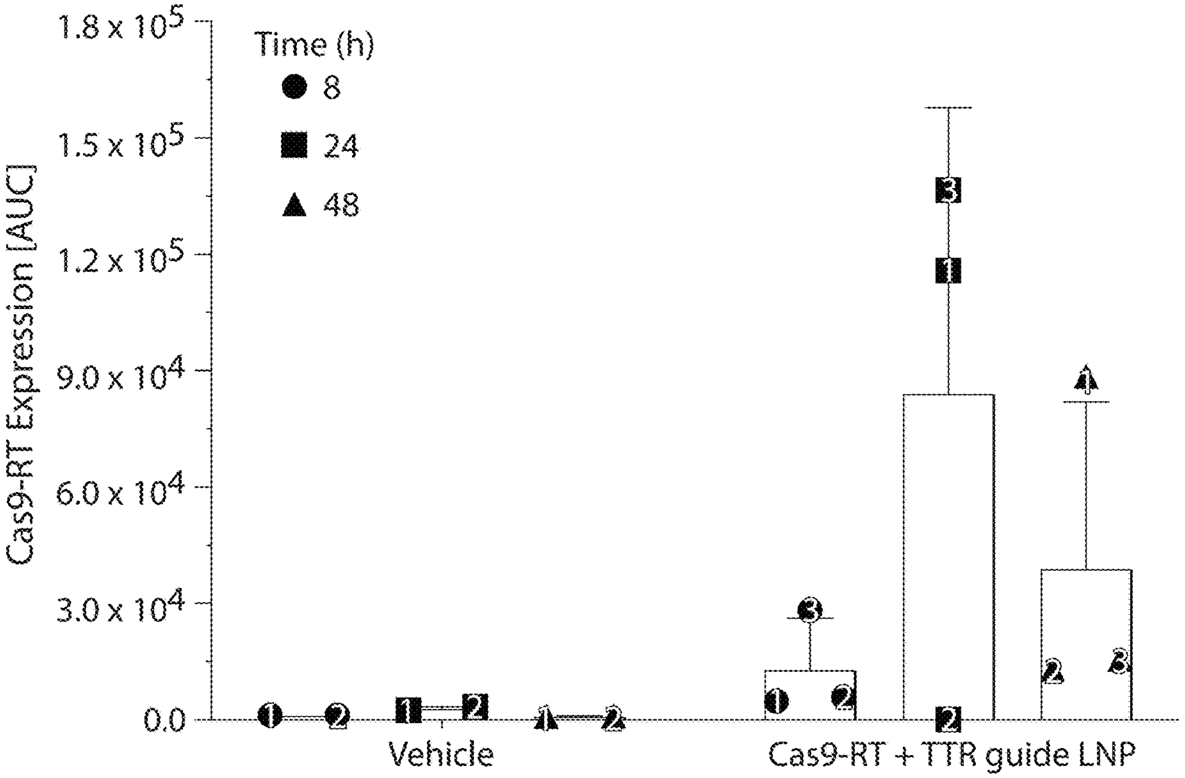
FIG. 11 is a graph showing Cas9-RT Expression after infusion of Cas9-RT mRNA+TTR guide LNP. Relative expression quantified by ProteinSimple Jess capillary electrophoresis Western blot. Numbers in the symbols are animal number in group. Vehicle n=2, Cas9-RT+TTR guide n=3.
Figure 12:
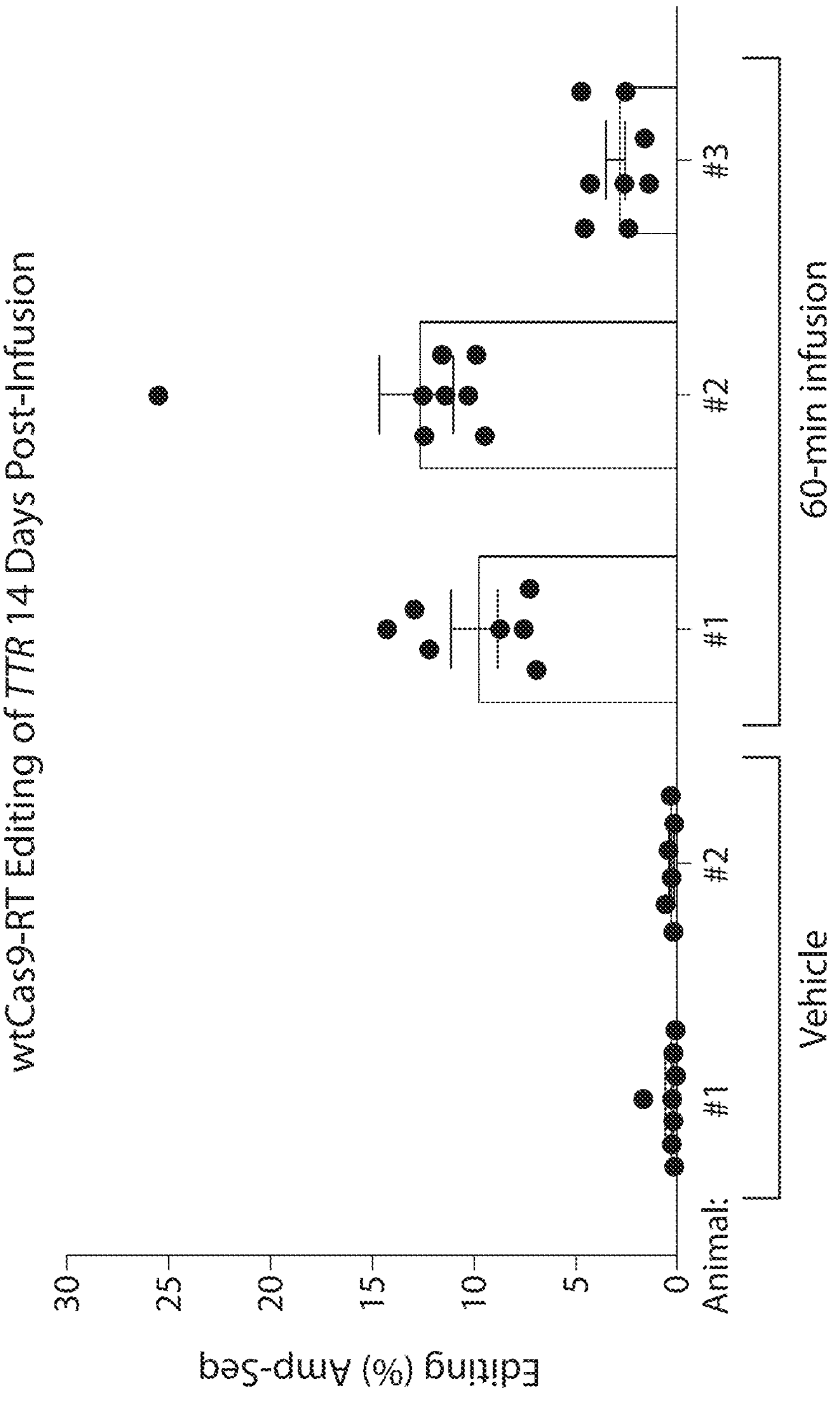
FIG. 12 is a graph showing gene editing of TTR locus after infusion of Cas9-RT mRNA+TTR guide LNP. Level of indels detected at the TTR locus were measured by amplicon sequencing of the TTR locus where the protospacer targets. Each animal had 8 different biopsies taken across the liver where amplicon sequencing measured the percentage of reads showing an indel.

Lipid nanoparticle (LNP) components (ionizable lipid, helper lipid, sterol, PEG) were dissolved in 100% ethanol with the lipid component molar ratios of 47:8:43.5:1.5, respectively. RNA (guide and mRNA) was combined in a 1:1 weight ratio and diluted to a concentration of 0.05-0.2 mg/mL in sodium acetate buffer, pH 5. RNA was formulated into distinct LNPs with a lipid amine to total RNA phosphate (N:P) molar ratio of 4.0. The LNPs were formed by microfluidic or turbulent mixing of the lipid and RNA solutions. A 3:1 ratio of aqueous to organic solvent was maintained during mixing using differential flow rates. After mixing, the LNPs were diluted, collected and buffer exchanged into 50 mM Tris, 9% sucrose buffer using tangential flow filtration. Formulations were concentrated to 1.0 mg/mL or higher then filtered through 0.2 μm sterile filter. The final LNP were stored at −80° C. until further use. The LNP formulations were delivered intravenously by infusion over the course of 1 hour at 2 mg/kg where the volume of the infusion was 5 ml/kg. Cynomolgus macaques from mainland Asia were given dexamethasone 2 mg/kg bolus via intramuscular injection 1.5-2 h prior to intravenous infusion using a syringe pump. Animals were monitored after infusion and the expression of the Cas9-RT was measured by laparoscopic biopsies taken from the liver 8-12 h, 24 h, and 48 h after infusion. Animals were euthanized 14 days after infusion and liver was harvested by dividing the organ up into 8 different segments to which the activity of gene editing of the TTR locus was assessed. Expression of the Cas9-RT gene editing polypeptide in liver was quantified by capillary electrophoresis western blot using the ProteinSimple Jess system (bio-techne) where Cas9 was detected by a mouse monoclonal antibody (7A9-3A3, Cell Signaling Technology). Relative expression of the Cas9-RT gene editing polypeptide was measured by an area under curve analysis, as shown in FIG. 11. Editing of the TTR locus was quantified by amplicon-sequencing of the TTR locus near the binding site of the protospacer. Editing of the TTR locus was observed, as shown in FIG. 12. These experiments demonstrate that the Cas9-RT polypeptide can be expressed in vivo in a non-human primate model and can edit the TTR locus.

Example 7: Evaluating Rewrite Efficiency of Exemplary Template RNAs and Second Strand-Nicking gRNAs with an Exemplary Gene Modifying Polypeptide in Correcting an F263S Mutation in a Murine Pah Gene in Murine Hepatocyte Cells This example describes the use of exemplary gene modifying systems containing either of two gene modifying polypeptides and template RNAs comprising varied lengths of heterologous object sequences and PBS sequences to quantify the activity of template RNAs for correction of an F263S mutation (corresponding to a T835C base change) in the murine Pah gene. In this example, a template RNA contained:

(1) a gRNA spacer;

(2) a gRNA scaffold;

(3) a heterologous object sequence; and (4) a primer binding site (PBS) sequence.

Exemplary template RNAs generated are given in Table E1. Two different versions of each template RNA were produced and tested (EM and HM), one with a first level and distributions of nucleotide modifications (e.g., phosphorothioate linkages denoted by an asterisk and/or 2'-O-methyl groups denoted by an 'm' preceding a nucleotide) and one with a second level and distribution.

In Examples 7-8, unless otherwise noted the HM version of a template RNA was used in the described experiments.

TABLE E1

Exemplary Template RNAs and Sequences

| RNACS | Name | Sequence | SEQ ID NO |
|---|---|---|---|
| RNACS1205 | EM_mPKU5_R19_P9 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrGrCrCrUrUrCrCrGrArGrUrCrUrUrCrCrArCrUrGrCrArCrArC*mA*mG*mU | 30437 |
| RNACS1256 | EM_mPKU5_R29_P8 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrGrGrGrUrGrGrCrCrUrGrGrCrCrUrUrCrCrGrArGrUrCrUrUrCrCrArCrUrGrCrArCrA*mC*mA*mG | 30438 |
| RNACS1184 | EM_mPKU5_R15_P10 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrUrCrCrGrArGrUrCrUrUrCrCrArCrUrGrCrArCrArCrA*mG*mU*mA | 30439 |
| RNACS1216 | EM_mPKU5_R21_P8 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrUrGrGrCrCrUrUrCrCrGrArGrUrCrUrUrCrCrArCrUrGrCrArCrA*mC*mA*mG | 30440 |
| RNACS1215 | EM_mPKU5_R21_P9 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrUrGrGrCrCrUrUrCrCrGrArGrUrCrUrUrCrCrArCrUrGrCrArCrArC*mA*mG*mU | 30441 |
| RNACS1204 | EM_mPKU5_R19_P10 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrGrCrCrUrUrCrCrGrArGrUrCrUrUrCrCrArCrUrGrCrArCrArCrA*mG*mU*mA | 30442 |
| RNACS1195 | EM_mPKU5_R17_P9 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrCrUrUrCrCrGrArGrUrCrUrUrCrCrArCrUrGrCrArCrArC*mA*mG*mU | 30443 |
| RNACS1206 | EM_mPKU5_R19_P8 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrGrCrCrUrUrCrCrGrArGrUrCrUrUrCrCrArCrUrGrCrArCrA*mC*mA*mG | 30444 |
| RNACS1166 | EM_mPKU5_R11_P8 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrArGrUrCrUrUrCrCrArCrUrGrCrArCrA*mC*mA*mG | 30445 |

TABLE E1-continued

Exemplary Template RNAs and Sequences

| RNACS | Name | Sequence | SEQ ID NO |
|---|---|---|---|
| RNACS1196 | EM_mPKU5_R17_P8 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrCrUrUrCrCrGrArGrUrCrUrUrCrCrArCrUrGrCrArCrA*mC*mA*mG | 30446 |
| RNACS1214 | EM_mPKU5_R21_P10 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrUrGrGrCrCrUrUrCrCrGrArGrUrCrUrUrCrCrArCrUrGrCrArCrArCrA*mG*mU*mA | 30447 |
| RNACS1186 | EM_mPKU5_R15_P8 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrUrCrCrGrArGrUrCrUrUrCrCrArCrUrGrCrArCrA*mC*mA*mG | 30448 |
| RNACS1185 | EM_mPKU5_R15_P9 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrUrCrCrGrArGrUrCrUrUrCrCrArCrUrGrCrArCrArC*mA*mG*mU | 30449 |
| RNACS1174 | EM_mPKU5_R13_P10 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrCrGrArGrUrCrUrUrCrCrArCrUrGrCrArCrArCrA*mG*mU*mA | 30450 |
| RNACS1175 | EM_mPKU5_R13_P9 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrCrGrArGrUrCrUrUrCrCrArCrUrGrCrArCrArC*mA*mG*mU | 30451 |
| RNACS425 | EM_mPKU52.1 | mC*mC*mU*rArArUrGrUrArCrUrGrUrGrUrGrCrArGrUrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrUrUrCrCrGrArGrUrCrUrUrCrCrArCrUrGrCrArCrArCrArGrUrA*mC*mA*mU | 30452 |
| RNACS1375 | EM_mPKU6_R18_P9 | mG*mC*mC*rUrArArUrGrUrArCrUrGrUrGrUrGrCrArGrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrCrUrUrCrCrGrArGrUrCrUrUrCrCrArCrUrGrCrArCrArCrA*mG*mU*mA | 30453 |
| RNACS1385 | EM_mPKU6_R20_P9 | mG*mC*mC*rUrArArUrGrUrArCrUrGrUrGrUrGrCrArGrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrGrCrCrUrUrCrCrGrArGrUrCrUrUrCrCrArCrUrGrCrArCrArCrA*mG*mU*mA | 30454 |
| RNACS1355 | EM_mPKU6_R14_P9 | mG*mC*mC*rUrArArUrGrUrArCrUrGrUrGrUrGrCrArGrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrCrGrArGrUrCrUrUrCrCrArCrUrGrCrArCrArCrA*mG*mU*mA | 30455 |
| RNACS3664 | EM_mPKU61.2 | mG*mC*mC*rUrArArUrGrUrArCrUrGrUrGrUrGrCrArGrGrUrUrUrUrArGrArGrCrUrArGrArArArUrArGrCrArArGrUrUrArArArArUrArArGrGrCrUrArGrUrCrCrGrUrUrArUrCrArArCrUrUrGrArArArArArGrUrGrGrCrArCrCrGrArGrUrCrGrGrUrGrCrCrCrUrUrCrCrGrArGrUrCrUrUrCrCrArCrUrGrCrArCrArCrArGrUrArC*mA*mU*mU | 30456 |
| RNACS3665 | HM_mPKU5_R19_P9 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrUrUrCrCrGrArGrUrCrUrUrCrCrArCrUrGrCrArCrArC*mA*mG*mU | 30457 |
| RNACS3666 | HM_mPKU5_R29_P8 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrGrGrUrGrGrCrCrUrGrGrCrCrUrUrCrCrGrArGrUrCrUrUrCrCrArCrUrGrCrArCrA*mC*mA*mG | 30458 |
| RNACS3460 | HM_mPKU5_R15_P10 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrCrCrGrArGrUrCrUrUrCrCrArCrUrGrCrArCrArCrA*mG*mU*mA | 30459 |
| RNACS3667 | HM_mPKU5_R21_P8 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrGrCrCrUrUrCrCrGrArGrUrCrUrUrCrCrArCrUrGrCrArCrA*mC*mA*mG | 30460 |

TABLE E1-continued

Exemplary Template RNAs and Sequences

| RNACS | Name | Sequence | SEQ ID NO |
|---|---|---|---|
| RNACS3668 | HM_mPKU5_R21_P9 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrGrCrCrUrUrCrCrGrArGrUrCrUrUrCrCrArCrUrGrCrArCrArC*mA*mG*mU | 30461 |
| RNACS3669 | HM_mPKU5_R19_P10 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrUrUrCrCrGrArGrUrCrUrUrCrCrArCrUrGrCrArCrArCrA*mG*mU*mA | 30462 |
| RNACS2302 | HM_mPKU5_R17_P9 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrUrCrCrGrArGrUrCrUrUrCrCrArCrUrGrCrArCrArC*mA*mG*mU | 30463 |
| RNACS3670 | HM_mPKU5_R19_P8 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrUrUrCrCrGrArGrUrCrUrUrCrCrArCrUrGrCrArCrA*mC*mA*mG | 30464 |
| RNACS1855 | HM_mPKU5_R11_P8 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArGrUrCrUrUrCrCrArCrUrGrCrArCrA*mC*mA*mG | 30465 |
| RNACS3671 | HM_mPKU5_R17_P8 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrUrCrCrGrArGrUrCrUrUrCrCrArCrUrGrCrArCrA*mC*mA*mG | 30466 |
| RNACS3672 | HM_mPKU5_R21_P10 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrGrCrCrUrUrCrCrGrArGrUrCrUrUrCrCrArCrUrGrCrArCrArCrA*mG*mU*mA | 30467 |
| RNACS1862 | HM_mPKU5_R15_P8 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrCrCrGrArGrUrCrUrUrCrCrArCrUrGrCrArCrA*mC*mA*mG | 30468 |
| RNACS2103 | HM_mPKU5_R15_P9 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrCrCrGrArGrUrCrUrUrCrCrArCrUrGrCrArCrArC*mA*mG*mU | 30469 |
| RNACS2104 | HM_mPKU5_R13_P10 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArGrUrCrUrUrCrCrArCrUrGrCrArCrArCrA*mG*mU*mA | 30470 |
| RNACS2099 | HM_mPKU5_R13_P9 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArGrUrCrUrUrCrCrArCrUrGrCrArCrArC*mA*mG*mU | 30471 |
| RNACS3673 | HM_mPKU52.1 | mC*mC*mU*rArArUrGrUrArCrUrGrUrGrUrGrCrArGrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrCrCrGrArGrUrCrUrUrCrCrArCrUrGrCrArCrArCrArGrUrA*mC*mA*mU | 30472 |
| RNACS1869 | HM_mPKU6_R18_P9 | mG*mC*mC*rUrArArUrGrUrArCrUrGrUrGrUrGrCrArGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrUrCrCrGrArGrUrCrUrUrCrCrArCrUrGrCrArCrArCrA*mG*mU*mA | 30473 |
| RNACS3674 | HM_mPKU6_R20_P9 | mG*mC*mC*rUrArArUrGrUrArCrUrGrUrGrUrGrCrArGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrUrUrCrCrGrArGrUrCrUrUrCrCrArCrUrGrCrArCrArCrA*mG*mU*mA | 30474 |
| RNACS2303 | HM_mPKU6_R14_P9 | mG*mC*mC*rUrArArUrGrUrArCrUrGrUrGrUrGrCrArGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArGrUrCrUrUrCrCrArCrUrGrCrArCrArCrA*mG*mU*mA | 30475 |

TABLE E1-continued

| Exemplary Template RNAs and Sequences | | | |
|---|---|---|---|
| RNACS | Name | Sequence | SEQ ID NO |
| RNACS3 675 | HM_mPKU6 1.2 | mG*mC*mC*rUrArArUrGrUrArCrUrGrUrGrUrGrCrArGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrUrUrCrCrGrArGrUrCrUrUrCrCrArCrUrGrCrArCrArCrArGrUrArC*mA*mU*mU | 30476 |

Table E1A shows the sequences of E1 without chemical modifications. In some embodiments, the sequences of Table E1A may be used without chemical modifications, or with one or more chemical modifications.

TABLE E1A

| Table E1 Sequences without Chemical Modifications | | | |
|---|---|---|---|
| RNACS | Name | Sequence | SEQ ID NO |
| RNACS 1205 | EM_mPKU 5_R19_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCGCCUUCCGAGUCUUCCACUGCACACAGU | 37166 |
| RNACS 1256 | EM_mPKU 5_R29_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCGGGUGGCCUGGCCUUCCGAGUCUUCCACUGCACACAG | 37167 |
| RNACS 1184 | EM_mPKU 5_R15_P10 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUCCGAGUCUUCCACUGCACACAGUA | 37168 |
| RNACS 1216 | EM_mPKU 5_R21_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUGGCCUUCCGAGUCUUCCACUGCACACAG | 37169 |
| RNACS 1215 | EM_mPKU 5_R21_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUGGCCUUCCGAGUCUUCCACUGCACACAGU | 37170 |
| RNACS 1204 | EM_mPKU 5_R19_P10 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCGCCUUCCGAGUCUUCCACUGCACACAGUA | 37171 |
| RNACS 1195 | EM_mPKU 5_R17_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCCUUCCGAGUCUUCCACUGCACACAGU | 37172 |
| RNACS 1206 | EM_mPKU 5_R19_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCGCCUUCCGAGUCUUCCACUGCACACAG | 37173 |
| RNACS 1166 | EM_mPKU 5_R11_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCAGUCUUCCACUGCACACAG | 37174 |
| RNACS 1196 | EM_mPKU 5_R17_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCCUUCCGAGUCUUCCACUGCACACAG | 37175 |
| RNACS 1214 | EM_mPKU 5_R21_P10 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUGGCCUUCCGAGUCUUCCACUGCACACAGUA | 37176 |
| RNACS 1186 | EM_mPKU 5_R15_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUCCGAGUCUUCCACUGCACACAG | 37177 |
| RNACS 1185 | EM_mPKU 5_R15_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUCCGAGUCUUCCACUGCACACAGU | 37178 |
| RNACS 1174 | EM_mPKU 5_R13_P10 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCCGAGUCUUCCACUGCACACAGUA | 37179 |
| RNACS 1175 | EM_mPKU 5_R13_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCCGAGUCUUCCACUGCACACAGU | 37180 |
| RNACS 425 | EM_mPKU 5_2.1 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUUCCGAGUCUUCCACUGCACACAGUACAU | 37181 |
| RNACS 1375 | EM_mPKU 6_R18_P9 | GCCUAAUGUACUGUGUGCAGGUUUUAGAGCUAGAAAUAGCAAGUUAAAAUAAGGCUAGUCCGUUAUCAACUUGAAAAAGUGGCACCGAGUCGGUGCCUUCCGAGUCUUCCACUGCACACAGUA | 37182 |
| RNACS 1385 | EM_mPKU 6_R20_P9 | GCCUAAUGUACUGUGUGCAGGUUUUAGAGCUAGAAAUAGCAAGUUAAAAUAAGGCUAGUCCGUUAUCAACUUGAAAAAGUGGCACCGAGUCGGUGCGCCUUCCGAGUCUUCCACUGCACACAGUA | 37183 |

TABLE E1A-continued

Table E1 Sequences without Chemical Modifications

| RNACS | Name | Sequence | SEQ ID NO |
|---|---|---|---|
| RNACS 1355 | EM_mPKU6_R14_P9 | GCCUAAUGUACUGUGUGCAGGUUUUAGAGCUAGAAAUAGCAAGUUAAAAUAAGGCUAGUCCGUUAUCAACUUGAAAAAGUGGCACCGAGUCGGUGCCGAGUCUUCCACUGCACACAGUA | 37184 |
| RNACS 3664 | EM_mPKU6_1.2 | GCCUAAUGUACUGUGUGCAGGUUUUAGAGCUAGAAAUAGCAAGUUAAAAUAAGGCUAGUCCGUUAUCAACUUGAAAAAGUGGCACCGAGUCGGUGCCCUUCCGAGUCUUCCACUGCACACAGUACAUU | 37185 |
| RNACS 3665 | HM_mPKU5_R19_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCGCCUUCCGAGUCUUCCACUGCACACAGU | 37186 |
| RNACS 3666 | HM_mPKU5_R29_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCGGGUGGCCUGGCCUUCCGAGUCUUCCACUGCACACAG | 37187 |
| RNACS 3460 | HM_mPKU5_R15_P10 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUCCGAGUCUUCCACUGCACACAGUA | 37188 |
| RNACS 3667 | HM_mPKU5_R21_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUGGCCUUCCGAGUCUUCCACUGCACACAG | 37189 |
| RNACS 3668 | HM_mPKU5_R21_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUGGCCUUCCGAGUCUUCCACUGCACACAGU | 37190 |
| RNACS 3669 | HM_mPKU5_R19_P10 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCGCCUUCCGAGUCUUCCACUGCACACAGUA | 37191 |
| RNACS 2302 | HM_mPKU5_R17_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCCUUCCGAGUCUUCCACUGCACACAGU | 37192 |
| RNACS 3670 | HM_mPKU5_R19_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCGCCUUCCGAGUCUUCCACUGCACACAG | 37193 |
| RNACS 1855 | HM_mPKU5_R11_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCAGUCUUCCACUGCACACAG | 37194 |
| RNACS 3671 | HM_mPKU5_R17_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCCUUCCGAGUCUUCCACUGCACACAG | 37195 |
| RNACS 3672 | HM_mPKU5_R21_P10 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUGGCCUUCCGAGUCUUCCACUGCACACAGUA | 37196 |
| RNACS 1862 | HM_mPKU5_R15_P8 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUCCGAGUCUUCCACUGCACACAG | 37197 |
| RNACS 2103 | HM_mPKU5_R15_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUCCGAGUCUUCCACUGCACACAGU | 37198 |
| RNACS 2104 | HM_mPKU5_R13_P10 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCCGAGUCUUCCACUGCACACAGUA | 37199 |
| RNACS 2099 | HM_mPKU5_R13_P9 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCCGAGUCUUCCACUGCACACAGU | 37200 |
| RNACS 3673 | HM_mPKU5_2.1 | CCUAAUGUACUGUGUGCAGUGUUUUAGAGCUAGAAAUAGCAAGUUAAAAUAAGGCUAGUCCGUUAUCAACUUGAAAAAGUGGCACCGAGUCGGUGCUUCCGAGUCUUCCACUGCACACAGUACAU | 37201 |
| RNACS 1869 | HM_mPKU6_R18_P9 | GCCUAAUGUACUGUGUGCAGGUUUUAGAGCUAGAAAUAGCAAGUUAAAAUAAGGCUAGUCCGUUAUCAACUUGAAAAAGUGGCACCGAGUCGGUGCCUUCCGAGUCUUCCACUGCACACAGUA | 37202 |
| RNACS 3674 | HM_mPKU6_R20_P9 | GCCUAAUGUACUGUGUGCAGGUUUUAGAGCUAGAAAUAGCAAGUUAAAAUAAGGCUAGUCCGUUAUCAACUUGAAAAAGUGGCACCGAGUCGGUGCGCCUUCCGAGUCUUCCACUGCACACAGUA | 37203 |
| RNACS 2303 | HM_mPKU6_R14_P9 | GCCUAAUGUACUGUGUGCAGGUUUUAGAGCUAGAAAUAGCAAGUUAAAAUAAGGCUAGUCCGUUAUCAACUUGAAAAAGUGGCACCGAGUCGGUGCCGAGUCUUCCACUGCACACAGUA | 37204 |
| RNACS 3675 | HM_mPKU6_1.2 | GCCUAAUGUACUGUGUGCAGGUUUUAGAGCUAGAAAUAGCAAGUUAAAAUAAGGCUAGUCCGUUAUCAACUUGAAAAAGUGGCACCGAGUCGGUGCCCUUCCGAGUCUUCCACUGCACACAGUACAUU | 37205 |

In this example, exemplary gene modifying polypeptide RNAV209 was examined. Gene modifying polypeptide 1 (RNAV209) comprised two NLS sequences (e.g., a c-Myc NLS and an SV40 NLS), an exemplary endonuclease domain comprising nCas9 which comprised an N863A mutation relative to wildtype Cas9, an exemplary RT domain comprising a MoMLV RT sequence (comprising D200N, T306K, W313F, T330P, and L603W mutations relative to a wildtype MoMLV RT sequence), and an exemplary flexible linker connecting the RT and endonuclease domains and comprising the amino acid sequence of SEQ ID NO: 6. The amino acid sequence of RNAV209 is given by SEQ ID NO: 30477.

(SEQ ID NO: 30477)

MPAAKRVKLDGGDKKYSIGLDIGTNSVGWAVITDEYKVPS
KKFKVLGNTDRHSIKKNLIGALLFDSGETAEATRLKRTAR
RRYTRRKNRICYLQEIFSNEMAKVDDSFFHRLEESFLVEE
DKKHERHPIFGNIVDEVAYHEKYPTIYHLRKKLVDSTDKA
DLRLIYLALAHMIKFRGHFLIEGDLNPDNSDVDKLFIQLV
QTYNQLFEENPINASGVDAKAILSARLSKSRRLENLIAQL
PGEKKNGLFGNLIALSLGLTPNFKSNFDLAEDAKLQLSKD
TYDDDLDNLLAQIGDQYADLFLAAKNLSDAILLSDILRVN
TEITKAPLSASMIKRYDEHHQDLTLLKALVRQQLPEKYKE
IFFDQSKNGYAGYIDGGASQEEFYKFIKPILEKMDGTEEL
LVKLNREDLLRKQRTFDNGSIPHQIHLGELHAILRRQEDF
YPFLKDNREKIEKILTFRIPYYVGPLARGNSRFAWMTRKS
EETITPWNFEEVVDKGASAQSFIERMTNFDKNLPNEKVLP
KHSLLYEYFTVYNELTKVKYVTEGMRKPAFLSGEQKKAIV
DLLFKTNRKVTVKQLKEDYFKKIECFDSVEISGVEDRFNA
SLGTYHDLLKIIKDKDFLDNEENEDILEDIVLTLTLFEDR
EMIEERLKTYAHLFDDKVMKQLKRRRYTGWGRLSRKLING
IRDKQSGKTILDFLKSDGFANRNFMQLIHDDSLTFKEDIQ
KAQVSGQGDSLHEHIANLAGSPAIKKGILQTVKVVDELVK
VMGRHKPENIVIEMARENQTTQKGQKNSRERMKRIEEGIK
ELGSQILKEHPVENTQLQNEKLYLYYLQNGRDMYVDQELD
INRLSDYDVDHIVPQSFLKDDSIDNKVLTRSDKARGKSDN
VPSEEVVKKMKNYWRQLLNAKLITQRKFDNLTKAERGGLS
ELDKAGFIKRQLVETRQITKHVAQILDSRMNTKYDENDKL
IREVKVITLKSKLVSDFRKDFQFYKVREINNYHHAHDAYL
NAVVGTALIKKYPKLESEFVYGDYKVYDVRKMIAKSEQEI
GKATAKYFFYSNIMNFFKTEITLANGEIRKRPLIETNGET
GEIVWDKGRDFATVRKVLSMPQVNIVKKTEVQTGGFSKES
ILPKRNSDKLIARKKDWDPKKYGGFDSPTVAYSVLVVAKV
EKGKSKKLKSVKELLGITIMERSSFEKNPIDFLEAKGYKE
VKKDLIIKLPKYSLFELENGRKRMLASAGELQKGNELALP
SKYVNFLYLASHYEKLKGSPEDNEQKQLFVEQHKHYLDEI
IEQISEFSKRVILADANLDKVLSAYNKHRDKPIREQAENI
IHLFTLTNLGAPAAFKYFDTTIDRKRYTSTKEVLDATLIH
QSITGLYETRIDLSQLGGDSGGSSGGSSGSETPGTSESAT
PESSGGSSGGSSTLNIEDEYRLHETSKEPDVSLGSTWLSD
FPQAWAETGGMGLAVRQAPLIIPLKATSTPVSIKQYPMSQ
EARLGIKPHIQRLLDQGILVPCQSPWNTPLLPVKKPGTND
YRPVQDLREVNKRVEDIHPTVPNPYNLLSGLPPSHQWYTV
LDLKDAFFCLRLHPTSQPLFAFEWRDPEMGISGQLTWTRL

-continued

PQGFKNSPTLFNEALHRDLADFRIQHPDLILLQYVDDLLL
AATSELDCQQGTRALLQTLGNLGYRASAKKAQICQKQVKY
LGYLLKEGQRWLTEARKETVMGQPTPKTPRQLREFLGKAG
FCRLFIPGFAEMAAPLYPLTKPGTLFNWGPDQQKAYQEIK
QALLTAPALGLPDLTKPFELFVDEKQGYAKGVLTQKLGPW
RRPVAYLSKKLDPVAAGWPPCLRMVAAIAVLTKDAGKLTM
GQPLVILAPHAVEALVKQPPDRWLSNARMTHYQALLLDTD
RVQFGPVVALNPATLLPLPEEGLQHNCLDILAEAHGTRPD
LTDQPLPDADHTWYTDGSSLLQEGQRKAGAAVTTETEVIW
AKALPAGTSAQRAELIALTQALKMAEGKKLNVYTDSRYAF
ATAHIHGEIYRRRGWLTSEGKEIKNKDEILALLKALFLPK
RLSIIHCPGHQKGHSAEARGNRMADQAARKAAITETPDTS
TLLIENSSPSGGSKRTADGSEFEKRTADGSEFESPKKKAK
VE

Mouse primary hepatocytes were prepared for administration of a gene modifying system as follows. The liver from animals under anesthesia were cannulated at the vena cava and perfused with 1 mg/mL Liberase digestion buffer. Upon digestion, the entire liver was dissected, cells were released into suspension in media and remaining connective tissue was eliminated by filtration with 70 μm cell strainer. Viable hepatocytes were further purified from dead cells and non-parenchymal cells by centrifugation in a 40% Percoll solution.

Figure 13:
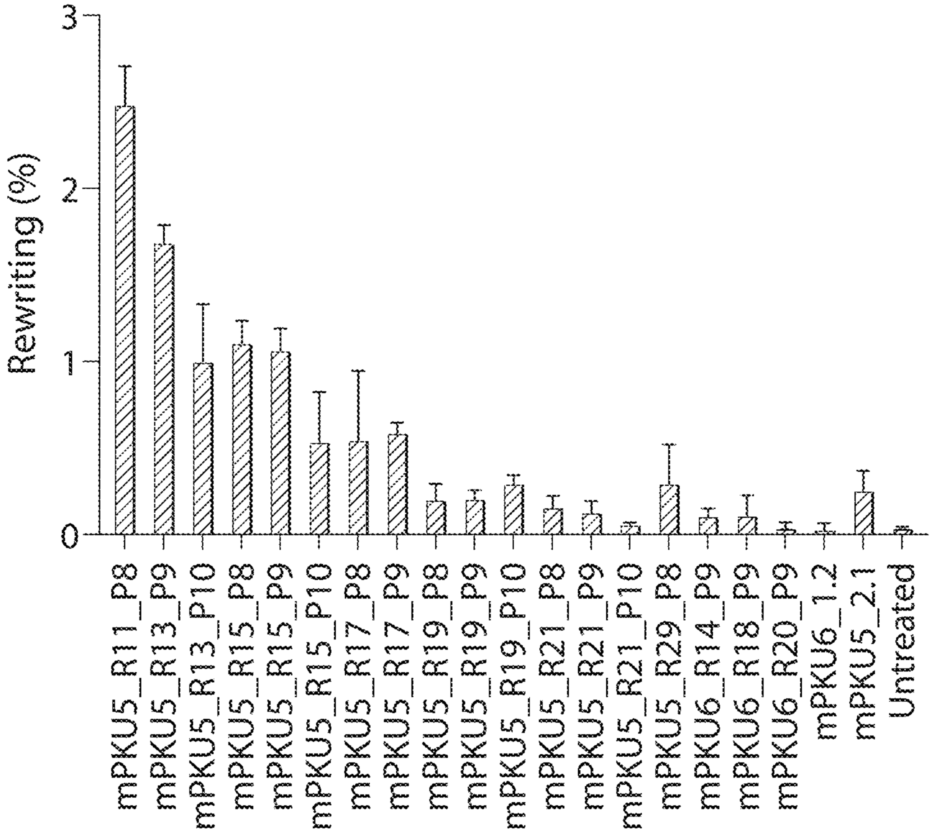
FIG. 13 is a graph showing percent rewriting in primary mouse hepatocytes nucleofected with various gene modifying systems.

A gene modifying system comprising a (i) RNAV209 gene modifying polypeptide described herein, and (ii) a template RNA of any of Table E1 was nucleofected into prepared mouse primary hepatocytes in RNA format. Specifically, 4 μg of gene modifying polypeptide mRNA was combined with 10 μg of template RNAs in a total volume of 5 μL. The mRNA and template RNAs are added to 20 μL P3 buffer containing 100,000 primary hepatocytes cells and cells were nucleofected. After nucleofection, cells were grown at 37° C., 5% $CO_2$ for 3 days prior to cell lysis and genomic DNA extraction. To analyze gene editing activity, primers flanking the Pah mutation site were used to amplify across the locus. Amplicons were analyzed via short read sequencing using an Illumina MiSeq. FIG. 13 shows a graph of the rewriting rate (the rate at which the target mutation was corrected) in primary mouse hepatocytes nucleofected with the indicated template RNA and RNAV209 gene modifying polypeptide as measured by Amp-SEQ. Rewriting was seen with a number of exemplary template RNAs.

Figure 14:
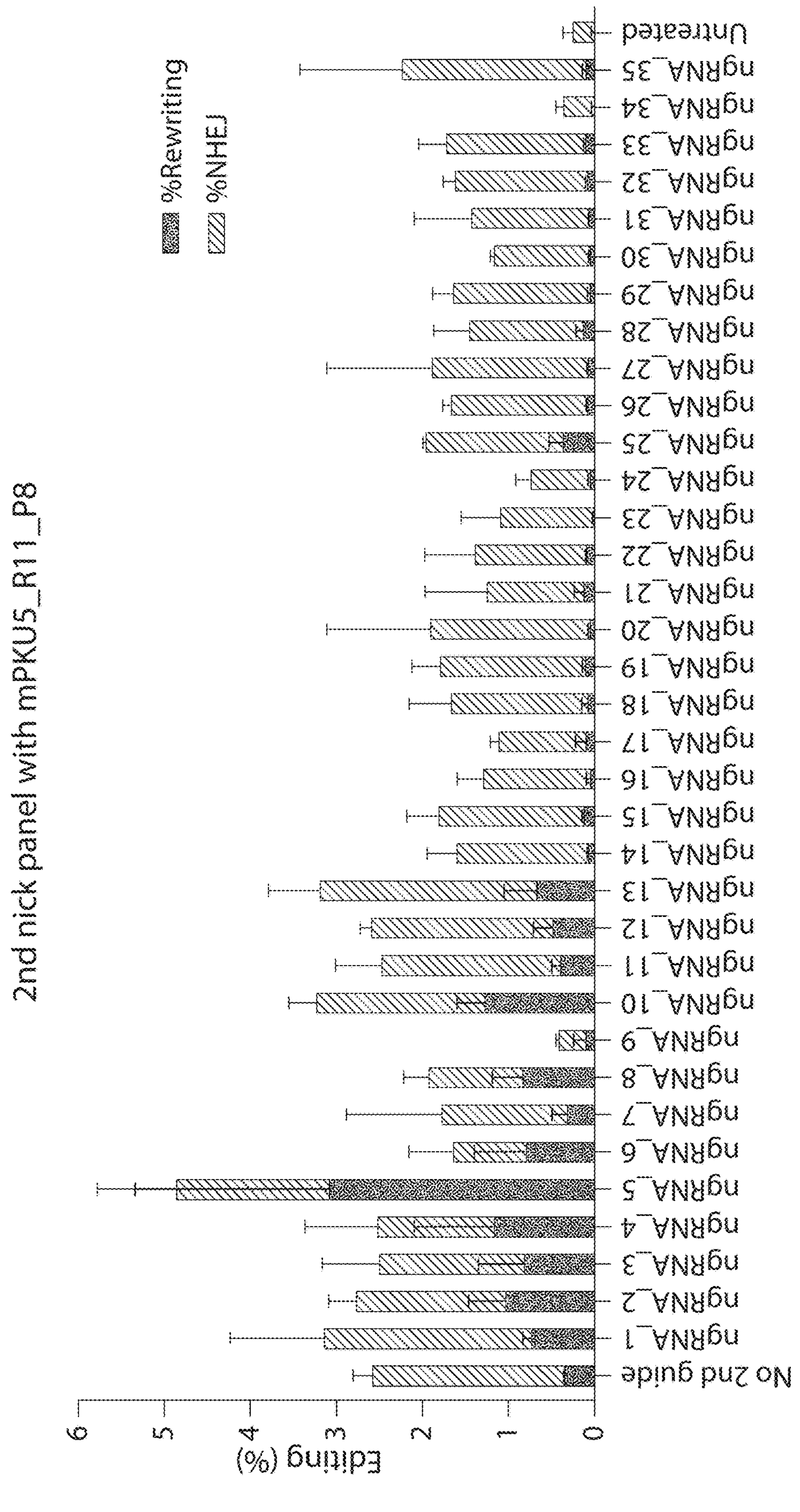
FIG. 14 is a graph showing percent editing in primary mouse hepatocytes nucleofected with various gene modifying systems containing second-nick gRNAs.

Higher rewriting rates can increase the impact of administered gene modifying systems and could decrease the amount of a gene modifying system required to achieve a therapeutic effect. Generation of a second nick to the second strand proximal to the template RNA specified nick may increase rewriting rate, e.g., by biasing cellular DNA repair toward incorporation of the mutation correction. To test the ability of a second nick to increase rewriting, exemplary second strand-targeting gRNAs were screened by administration with the top performing template RNA from FIG. 13 (mPKU5_R11_P8) and RNAV209 to mouse primary hepatocytes prepared as described above (FIG. 14).

TABLE E2

| Exemplary second strand-targeting gRNAs (ngRNAs) | | | |
|---|---|---|---|
| RNACS | Description | Sequence | SEQ ID NO |
| RNACS 2100 | mPKU_ ngRNA 1 | UAUAAAAAGCCUUGAGUUUUGUUUU AGAGCUAGAAAUAGCAAGUUAAAAU AAGGCUAGUCCGUUAUCAACUUGAA AAAGUGGCACCGAGUCGGUGCUUUU | 30478 |
| RNACS 2101 | mPKU_ ngRNA 5 | CUGUCGUCUCGAGAUUUCUUGUUUU AGAGCUAGAAAUAGCAAGUUAAAAU AAGGCUAGUCCGUUAUCAACUUGAA AAAGUGGCACCGAGUCGGUGCUUUU | 30479 |

Figure 15:
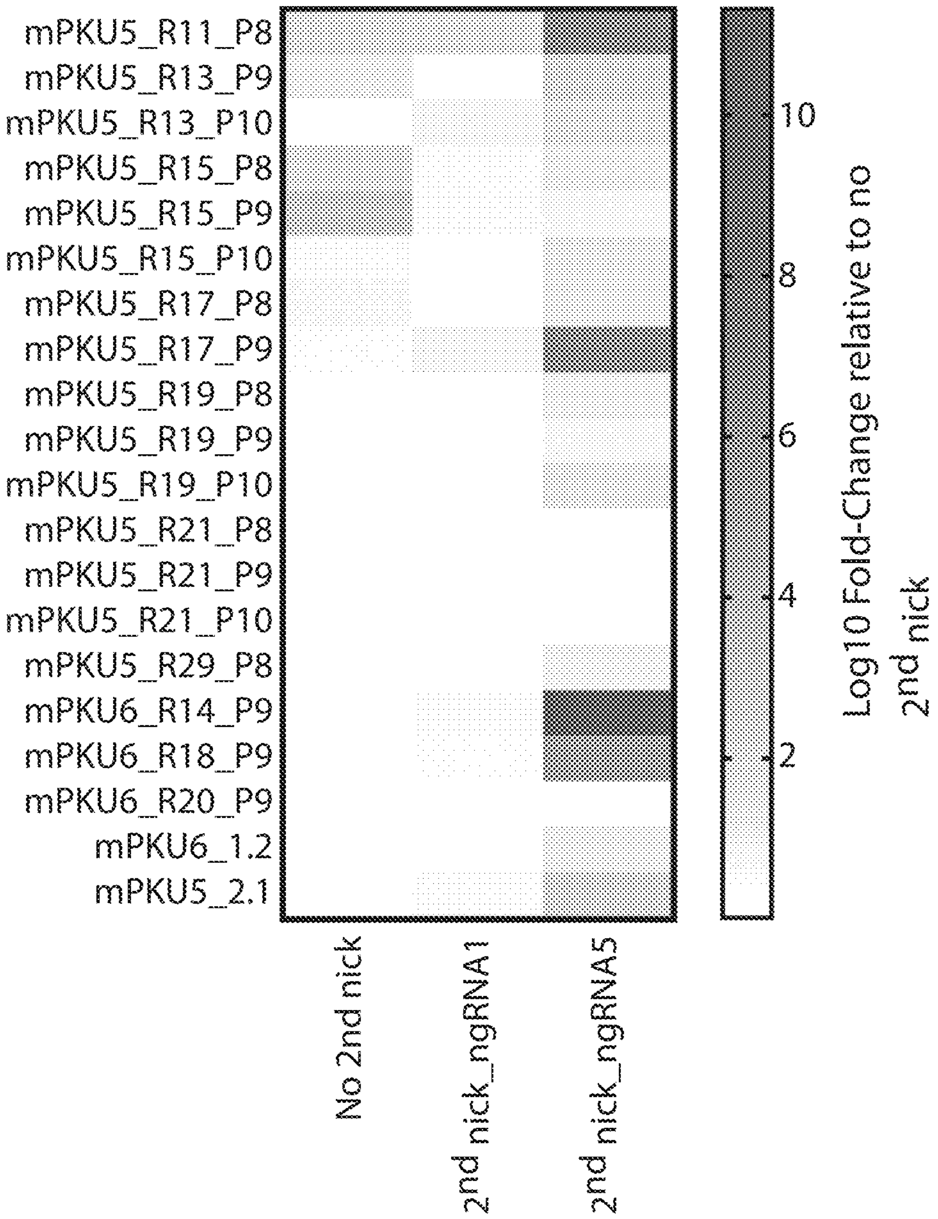
FIG. 15 is a heat map showing rewriting efficiency of various gene modifying systems with or without second-nick gRNAs.

The presence of second strand-targeting gRNAs increased the rewriting activity of the exemplary RNAV209/mPKU5_R11_P8 gene modifying system. Two second strand-targeting gRNAs were selected for further evaluation: ngRNA1 (specifying a second strand nick more than 100 bp from the mutation to be corrected) and ngRNA5 (specifying a second strand nick less than 40 bp from the mutation to be corrected). Template RNAs from Table E1 were combined with RNAV209 and either ngRNA1 or ngRNA5 and rewrite efficiency was evaluated as above (FIG. 15). ngRNA5 enhanced rewrite efficiency relative to the absence of second strand-targeting gRNA when combined with a number of template RNAs.

These results demonstrate that an exemplary gene modifying system comprising RNAV209 and any of a variety of template RNAs can correct a mutation in a murine PAH gene in murine hepatocytes, and that the efficiency of rewriting can be enhanced by the addition of a second nick specified by a second strand-nicking gRNA.

Example 8: Comparing Exemplary Template RNAs and Gene Modifying Polypeptides that Correct an F263S Mutation in a Murine Pah Gene in Marine Model Animals This example describes the use of exemplary gene modifying systems containing either of two gene modifying polypeptides and template RNAs comprising varied lengths and compositions of heterologous object sequences and PBS sequences to quantify the activity of template RNAs for correction of an F263S mutation (corresponding to a T835C base change) in the murine Pah gene. The enhancing effect of inclusion of a second strand-targeting gRNA was also examined. In this example, a template RNA contained:

(1) a gRNA spacer;
(2) a gRNA scaffold;
(3) a heterologous object sequence; and
(4) a primer binding site (PBS) sequence.

Exemplary template RNAs tested were template RNAs RNACS1855, RNACS1862, RNACS2103, RNACS2104, and RNACS2099, shown in Table E1. The exemplary second strand-targeting gRNA was RNACS2101, shown in Table E2.

Exemplary gene modifying polypeptide RNAV209 was compared to exemplary gene modifying polypeptide 2 (RNAIVT338). RNAIVT338 comprised two NLS sequences (e.g., a c-Myc NLS and an SV40 NLS), an exemplary endonuclease domain comprising Cas9, an exemplary RT domain comprising an AVIRE RT sequence, and an exemplary linker between the RT and endonuclease domains and comprising the amino acid sequence of SEQ ID NO: 217. The amino acid sequence of RNAIVT338 is given by SEQ ID NO: 30480.

(SEQ ID NO: 30480)

```
DKKYSIGLDIGTNSVGWAVITDEYKVPSKKFKVLGNTDRH
SIKKNLIGALLFDSGETAEATRLKRTARRRYTRRKNRICY
LQEIFSNEMAKVDDSFFHRLEESFLVEEDKKHERHPIFGN
IVDEVAYHEKYPTIYHLRKKLVDSTDKADLRLIYLALAHM
IKFRGHFLIEGDLNPDNSDVDKLFIQLVQTYNQLFEENPI
NASGVDAKAILSARLSKSRRLENLIAQLPGEKKNGLFGNL
IALSLGLTPNFKSNFDLAEDAKLQLSKDTYDDDLDNLLAQ
IGDQYADLFLAAKNLSDAILLSDILRVNTEITKAPLSASM
IKRYDEHHQDLTLLKALVRQQLPEKYKEIFFDQSKNGYAG
YIDGGASQEEFYKFIKPILEKMDGTEELLVKLNREDLLRK
QRTFDNGSIPHQIHLGELHAILRRQEDFYPFLKDNREKIE
KILTFRIPYYVGPLARGNSRFAWMTRKSEETITPWNFEEV
VDKGASAQSFIERMTNFDKNLPNEKVLPKHSLLYEYFTVY
NELTKVKYVTEGMRKPAFLSGEQKKAIVDLLFKTNRKVTV
KQLKEDYFKKIECFDSVEISGVEDRFNASLGTYHDLLKII
KDKDFLDNEENEDILEDIVLTLTLFEDREMIEERLKTYAH
LFDDKVMKQLKRRRYTGWGRLSRKLINGIRDKQSGKTILD
FLKSDGFANRNFMQLIHDDSLTFKEDIQKAQVSGQGDSLH
EHIANLAGSPAIKKGILQTVKVVDELVKVMGRHKPENIVI
EMARENQTTQKGQKNSRERMKRIEEGIKELGSQILKEHPV
ENTQLQNEKLYLYYLQNGRDMYVDQELDINRLSDYDVDHI
VPQSFLKDDSIDNKVLTRSDKARGKSDNVPSEEVVKKMKN
YWRQLLNAKLITQRKFDNLTKAERGGLSELDKAGFIKRQL
VETRQITKHVAQILDSRMNTKYDENDKLIREVKVITLKSK
LVSDFRKDFQFYKVREINNYHHAHDAYLNAVVGTALIKKY
PKLESEFVYGDYKVYDVRKMIAKSEQEIGKATAKYFFYSN
IMNFFKTEITLANGEIRKRPLIETNGETGEIVWDKGRDFA
TVRKVLSMPQVNIVKKTEVQTGGFSKESILPKRNSDKLIA
RKKDWDPKKYGGFDSPTVAYSVLVVAKVEKGKSKKLKSVK
ELLGITIMERSSFEKNPIDFLEAKGYKEVKKDLIIKLPKY
SLFELENGRKRMLASAGELQKGNELALPSKYVNFLYLASH
YEKLKGSPEDNEQKQLFVEQHKHYLDEIIEQISEFSKRVI
LADANLDKVLSAYNKHRDKPIREQAENIIHLFTLTNLGAP
AAFKYFDTTIDRKRYTSTKEVLDATLIHQSITGLYETRID
LSQLGGDGGAEAAAKEAAAKEAAAKEAAAKALEAEAAAKE
AAAKEAAAKEAAAKAGGTAPLEEEYRLFLEAPIQNVTLLE
QWKREIPKVWAEINPPGLASTQAPIHVQLLSTALPVRVRQ
YPITLEAKRSLRETIRKFRAAGILRPVHSPWNTPLLPVRK
```

-continued

```
SGTSEYRMVQDLREVNKRVETIHPTVPNPYTLLSLLPPDR

IWYSVLDLKDAFFCIPLAPESQLIFAFEWADAEEGESGQL

TWTRLPQGFKNSPTLFNEALNRDLQGFRLDHPSVSLLQYV

DDLLIAADTQAACLSATRDLLMTLAELGYRVSGKKAQLCQ

EEVTYLGFKIHKGSRSLSNSRTQAILQIPVPKTKRQVREF

LGKIGYCRLFIPGFAELAQPLYAATRPGNDPLVWGEKEEE

AFQSLKLALTQPPALALPSLDKPFQLFVEETSGAAKGVLT

QALGPWKRPVAYLSKRLDPVAAGWPRCLRAIAAAALLTRE

ASKLTFGQDIEITSSHNLESLLRSPPDKWLTNARITQYQV

LLLDPPRVRFKQTAALNPATLLPETDDTLPIHHCLDTLDS

LTSTRPDLTDQPLAQAEATLFTDGSSYIRDGKRYAGAAVV

TLDSVIWAEPLPIGTSAQKAELIALTKALEWSKDKSVNIY

TDSRYAFATLHVHGMIYRERGWLTAGGKAIKNAPEILALL

TAVWLPKRVAVMHCKGHQKDDAPTSTGNRRADEVAREVAI

RPLSTQATISAGKRTADGSEFEKRTADGSEFESPKKKAKV

E
```

Figure 16:
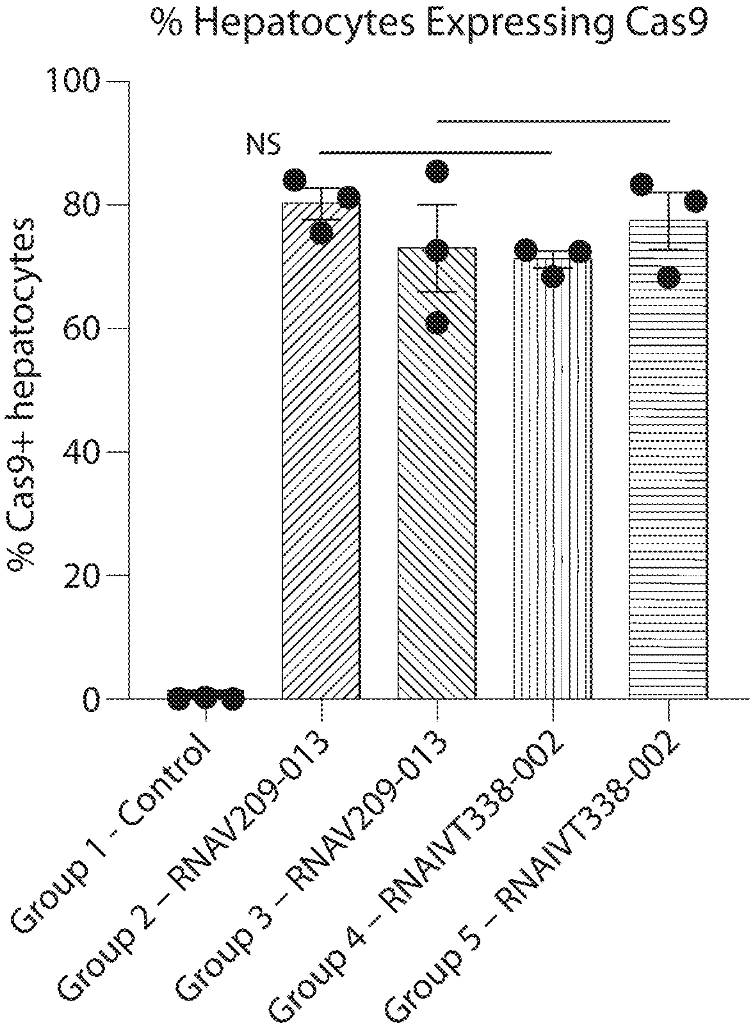
FIG. 16 is a graph showing the percent of mouse hepatocytes expressing Cas9 six hours post-dosing with various gene modifying systems.
Figure 17:
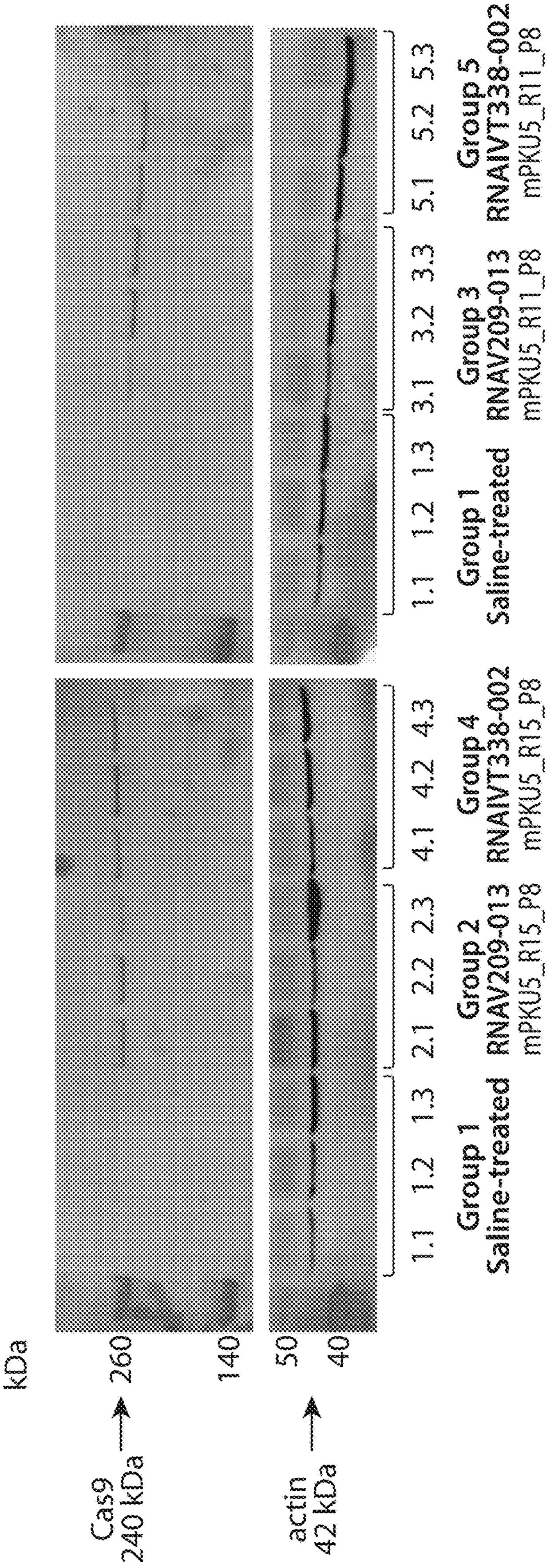
FIG. 17 is a pair of western blots showing expression of Cas9 in mouse liver samples six hours post-dosing with various gene modifying systems.

The gene modifying system comprising either RNAV209 or RNAIVT338 gene modifying polypeptide and a template RNA described above was formulated in LNP and delivered to mice. Specifically, approximately 1.6 or 2.4 mg/kg of total RNA equivalent formulated in LNPs, combined at 1:1 (w/w) of template RNA and mRNA, were dosed intravenously in 8 to 10-week-old, mixed gender ENU2 mice (0.8 mg/kg each of template RNA and mRNA, optionally with an additional 0.8 mg/kg of ngRNA for second strand-targeting experiments) in a 10 ml/kg bolus. Mice were administered a first dose at time 0 (t=0), and a second dose at t=24 hours. Six hours or 7 days post-dosing (as used herein post-dosing refers to time since the first dose), animals were sacrificed, and their liver and plasma collected for analyses. To determine the expression distribution of the gene modifying polypeptide in the liver, 6-hr liver samples were subjected to immunohistochemistry using an anti-Cas9 antibody. Upon staining, quantification of Cas9-positive hepatocytes was determined by QuPath Markup. As shown in FIG. 16, the expression of the gene modifying polypeptide was observed in 70-80% of hepatocytes. 6-hour liver samples were further analyzed by Western blot using an anti-Cas9 antibody. As shown in FIG. 17, expression of the gene modifying polypeptide was observed in liver from all treated animals. These results show that both RNAV209 and RNAIVT338 gene modifying polypeptides are expressed in murine liver at 6 hours post-dosing.

7-day plasma samples were analyzed by LC/MS to determine the level of phenylalanine present. ENU2 mice harbor a mutation in the murine PAH gene that inactivates the PAH enzyme, resulting in sharply higher Phe levels in plasma than healthy wildtype mice.

Phenylalanine was extracted from mouse plasma using protein precipitation and then analyzed by a LC-MS/MS system equipped with a Shimadzu Nexera UPLC (LC-40) coupled to a Sciex API 7500 mass spectrometer. Surrogate analyte (13C2,15N-Phenylalanine) was used for phenylalanine quantitation. Equivalence of ionization for naturally occurring and surrogate compounds was established prior to and after analytical run. Data were collected in the positive ion mode with three MRM transitions, 169.1 to 123.1 (13C2,15N-Phenylalanine), 166.1 to 120.1 (Phenylalanine) and 172.1 to 126.0 (13C6-Phenylalanine, internal standard). Extracted samples were injected onto an Acquity UPLC BEH C18 column (1.7 μm, 2.1×50 mm) and eluted using a gradient of 0% to 15% of mobile phase B at a flow rate of 0.8 mL/min with a total run time of 3 min per injection. Mobile phase A is 100:2:0.1 H2O:Formic acid (FA): Trifluoroacetic acid (TFA) and mobile phase B is 95:5:2:0.1 ACN:H2O:FA:TFA. Data were processed using Sciex OS software.

Figure 18:
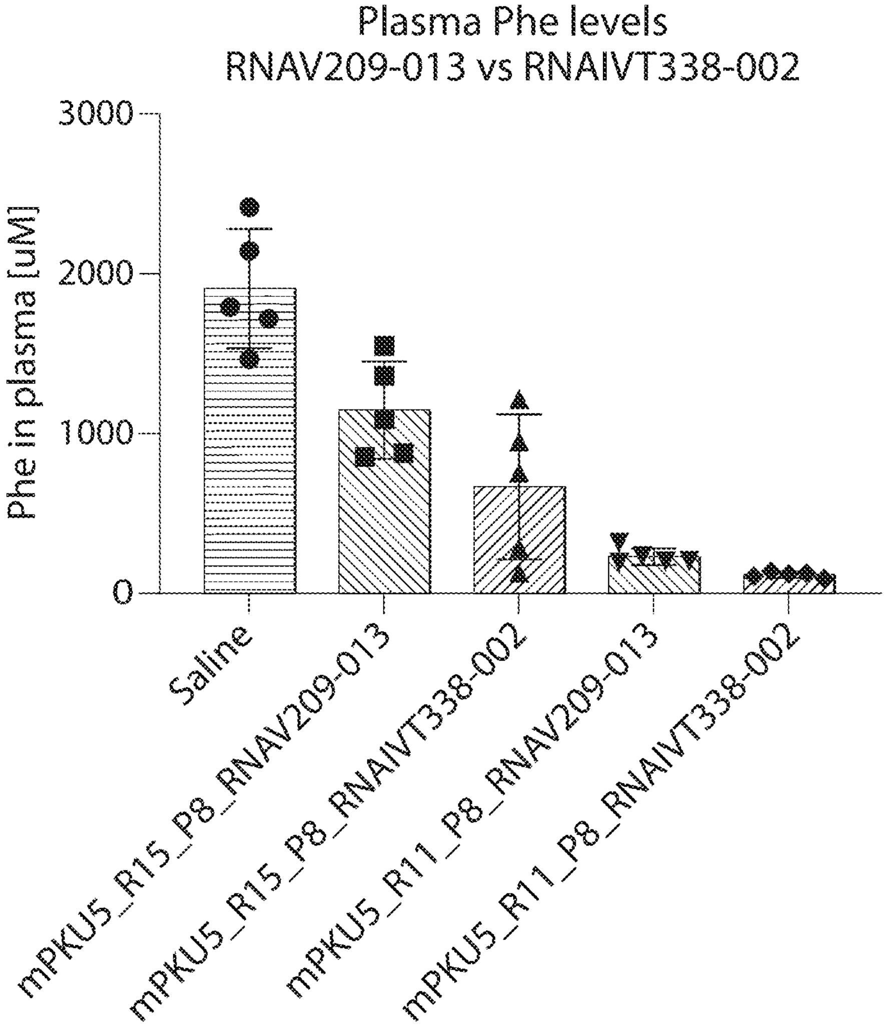
FIG. 18 is a graph showing the level of phenylalanine (Phe) present in plasma samples 7 days post-dosing with various gene modifying systems.

The results showed that Phe levels decreased in plasma from all treated mice, consistent with correction of the PAH deactivating point mutation using either gene modifying polypeptide and either of the template RNAs examined (FIG. 18). Treatment with LNP containing RNAIVT338 decreased Phe levels more than treatment with LNP containing RNAV209, with RNAIVT338 decreasing Phe levels by approximately 65% relative to saline compared to RNAV209 decreasing Phe levels by approximately 40%. Similarly, treatment using template RNACS1855 decreased Phe levels more than treatment with template RNACS1862, independent of which gene modifying polypeptide was administered. RNACS1855 contains a shorter reverse transcriptase binding sequence (11 nucleotides) than template RNACS1862 (15 nucleotides).

Figure 19A:
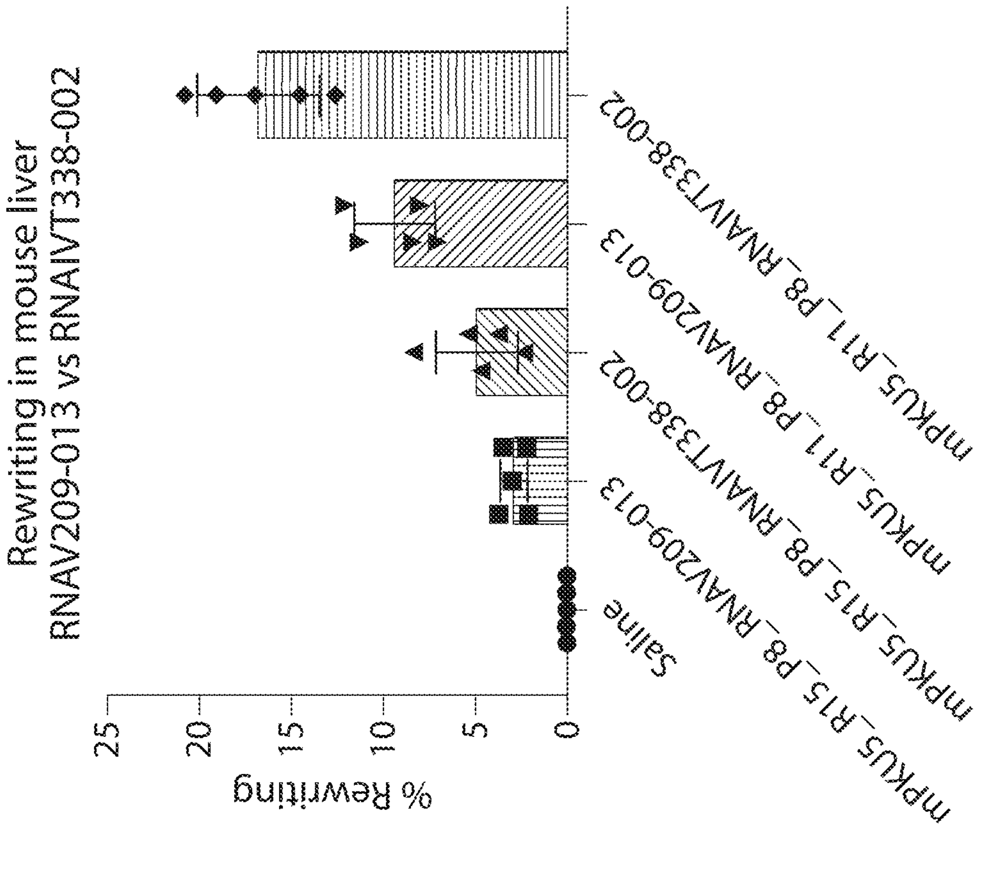
FIGS. 19A-19B are graphs showing percent rewriting (FIG. 19A) and percent indel (FIG. 19B) in mouse liver 7 days post-dosing with various gene modifying systems.
Figure 19B:
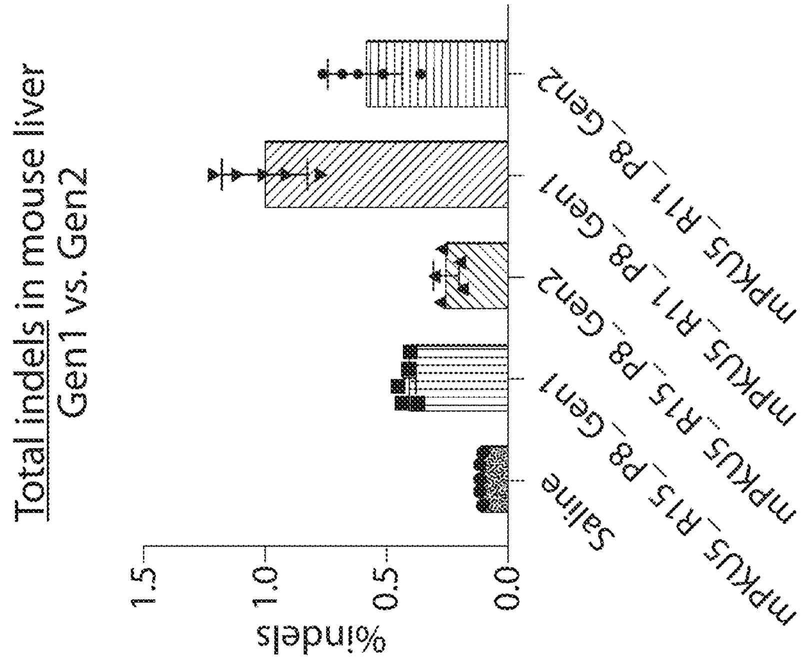
Figure 20A:
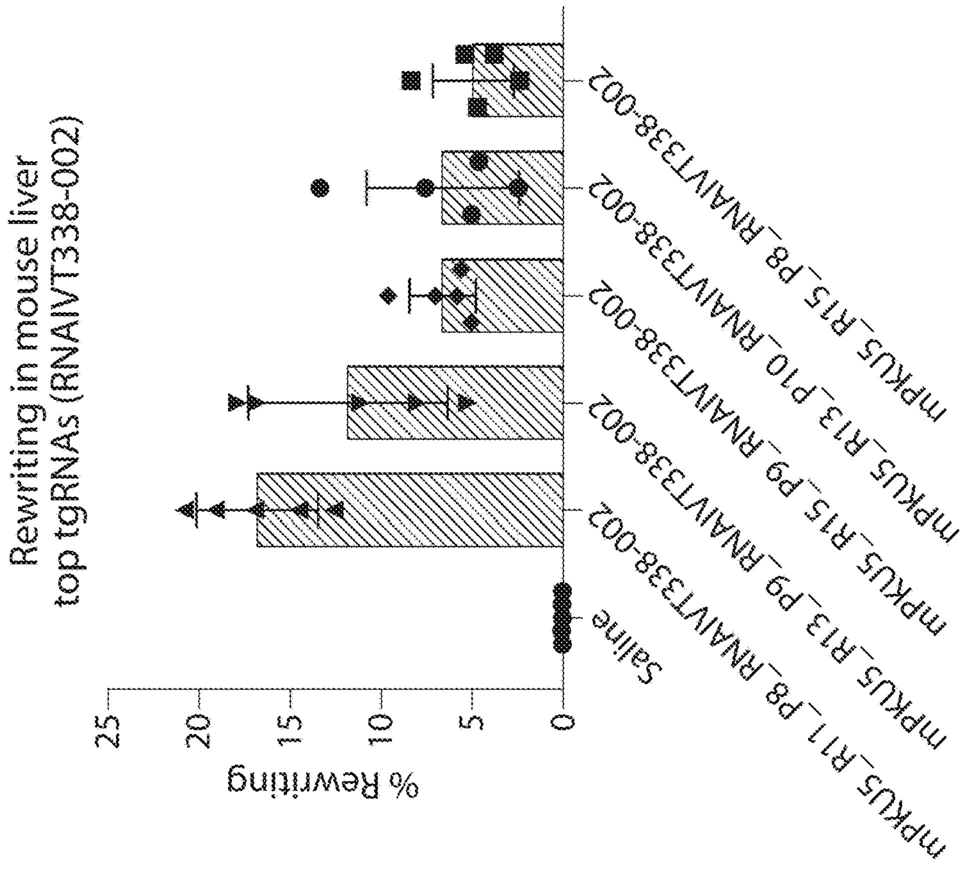
FIGS. 20A-20C are graphs showing percent rewriting in liver samples (FIG. 20A), levels of Phe in plasma (FIG. 20B), and percent indels in mouse liver (FIG. 20C) 7 days post-dosing with various gene modifying systems.
Figure 20B:
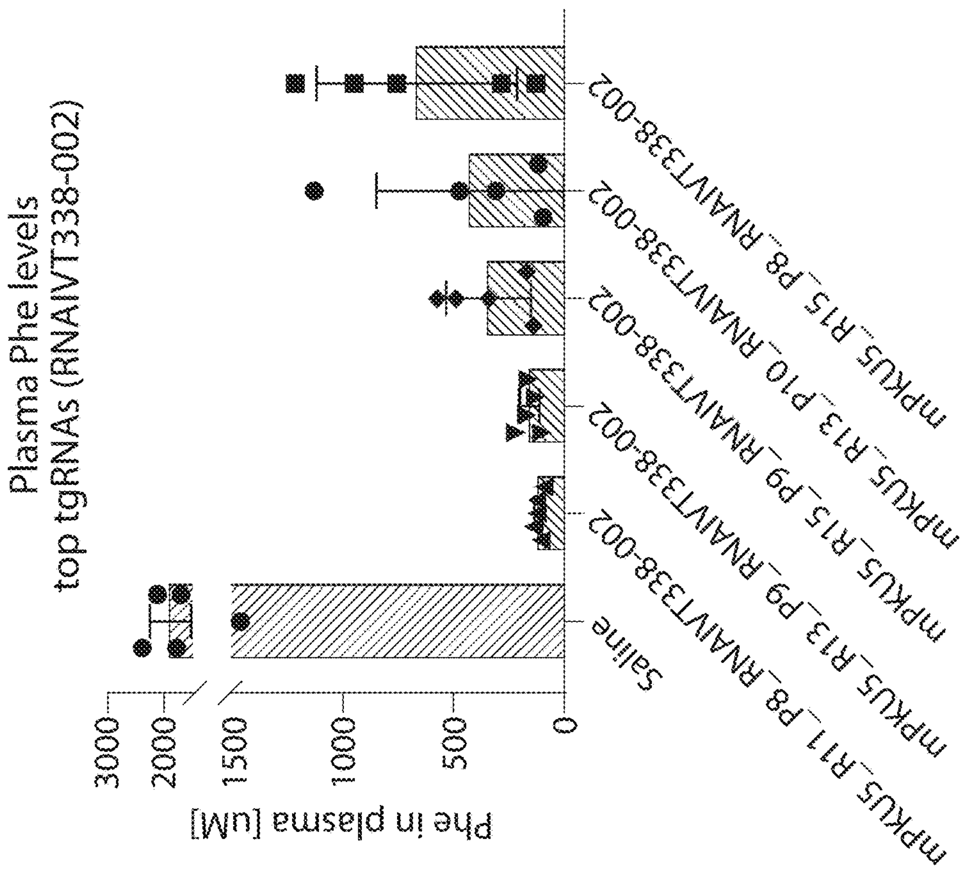
Figure 20C:
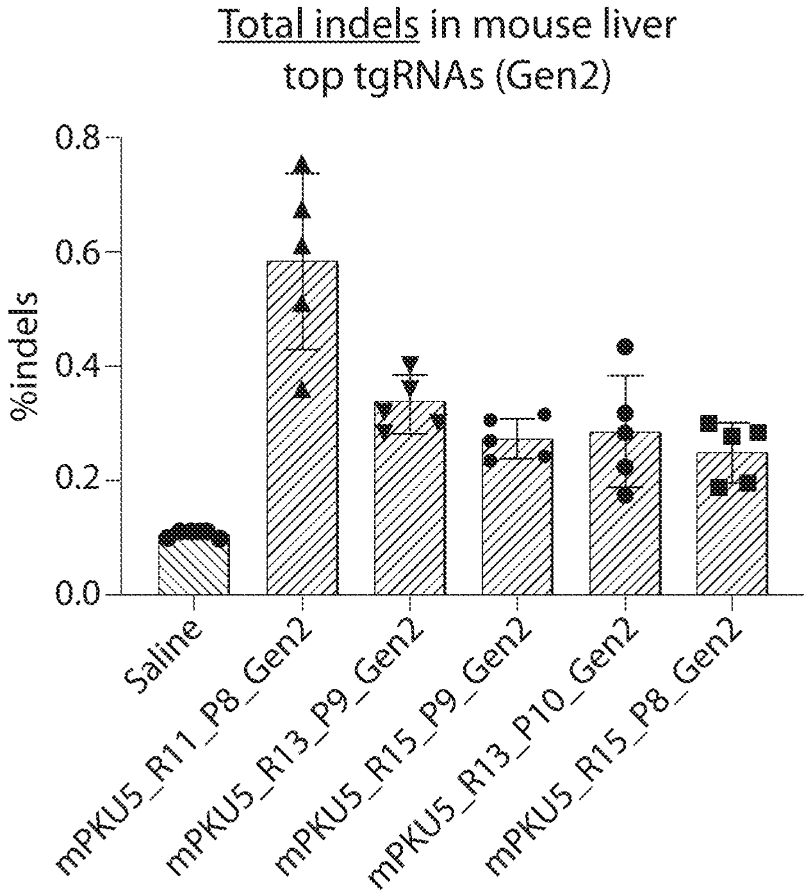

7-day liver samples were further analyzed using Amp-Seq to determine % rewriting and % INDEL in target liver cells (FIG. 19A and FIG. 19B). To analyze gene editing activity, primers flanking the target insertion site locus were used to amplify across the locus in the genomic DNA of liver samples. Amplicons were analyzed via short read sequencing using an Illumina MiSeq. Conversion of a C nucleotide to a T nucleotide at position 835 in the PAH gene indicates successful editing. Rewriting was observed from all treated mice, demonstrating that the gene modifying systems tested successfully corrected the PAH mutation (FIG. 19A). Treatment with LNP containing RNAIVT338 resulted in a higher rewrite % than treatment with LNP containing RNAV209, with approximately twice the rewrite % observed when using RNAIVT338 relative to RNAV209. Similarly, treatment using template RNACS1855 resulted in a higher rewrite % than treatment with template RNACS1862, independent of which gene modifying polypeptide was used. Treatment with LNP containing RNAIVT338 resulted in a lower INDEL % than treatment with LNP containing RNAV209, with almost half the INDEL % observed when using RNAIVT338 relative to RNAV209 (FIG. 19B). Treatment using template RNACS1855 resulted in a lower INDEL % than treatment with template RNACS1862, independent of which gene modifying polypeptide was used. Based on RNAIVT338's improved performance over RNAV209, additional template RNAs were tested in combination with RNAIVT338. ENU2 mice were treated as described above using a gene modifying system comprising RNAIVT338 and one of template RNAs RNACS1855, RNACS1862, RNACS2103, RNACS2104, and RNACS2099, and liver and plasma samples were taken from sacrificed mice at 7 days post-dosing (FIGS. 20A, 20B, and 20C). Rewriting was observed in all treated samples, with strong correlation between % rewriting in liver samples and Phe level reduction in plasma samples. INDEL % was much lower (approximately 25 to 35 times lower) than rewriting %, and correlated with rewriting % level (FIG. 20C). The results demonstrate that rewriting a disease-associated mutation using a gene modifying system containing RNAIVT338 can correct the disease-associated mutation and achieve the desired therapeutic effect (e.g., reduction in Phe level), and that RNAIVT338 achieves rewriting with a number of template RNAs. The results further demonstrate that the rewriting occurs with low levels of INDEL generation.

Figure 21A:
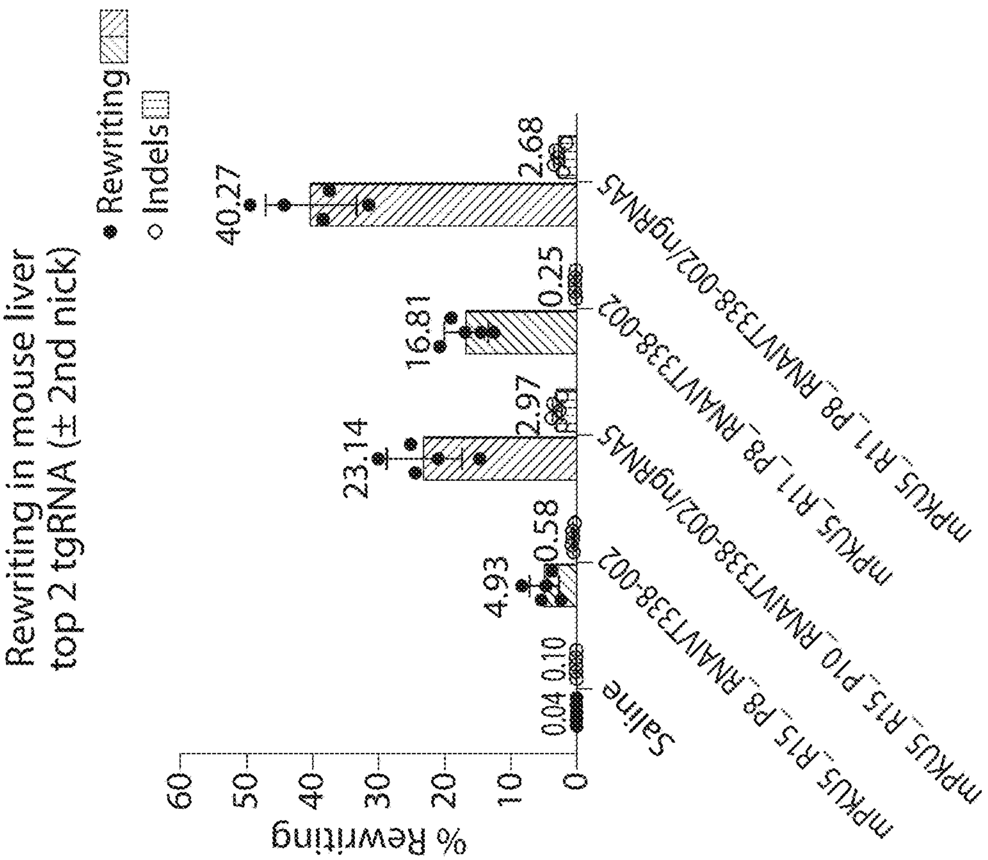
FIGS. 21A-21B are a pair of graphs showing percent rewriting and percent indel in liver samples (FIG. 21A) and levels of Phe in plasma (FIG. 21B) 7 days post-dosing with various gene modifying systems with or without second-nick gRNAs.
Figure 21B:
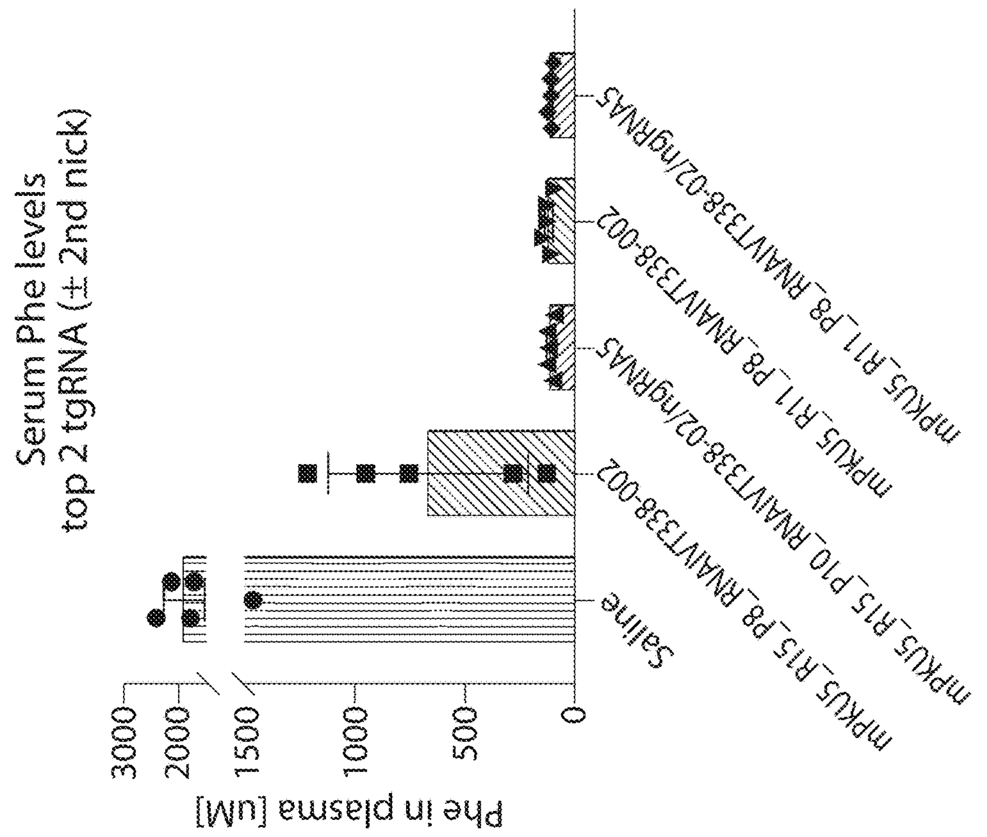

To determine whether second strand-nicking can enhance rewriting efficiency and improve Phe-reducing therapeutic effect, ENU2 mice were treated as described above with exemplary gene modifying system containing RNAIVT338, template RNA, as well as ngRNA5 which directs a second strand nick less than 40 bp from the target PAH mutation, and liver and plasma samples were analyzed as described above (FIGS. 21A and 21B). Administering a gene modifying system including a second strand-targeting gRNA increased % rewriting in liver and decreased plasma Phe levels relative to gene modifying systems not containing a second strand-targeting gRNA. Over 40% of the liver cells sampled contained the rewrite modification after mice were treated with a gene modifying system containing gene modifying polypeptide RNAIVT338 and an exemplary template RNA and second strand nicking gRNA (FIG. 21A), and this was accompanied by serum Phe levels of approximately 100 μM, physiologically normal for mice (FIG. 21B). Indel percent, while measurably higher when the second strand-targeting gRNA was included, remained low relative to rewriting percent. These results show adding a second strand nick proximal to the mutation to be corrected (e.g., biasing cellular DNA repair to favor correction of the mutation) can increase rewriting and substantially increase the therapeutic effect. These results further show that unintended modifications (e.g., indels) are not significantly increased by second strand nicking.

Figure 22:
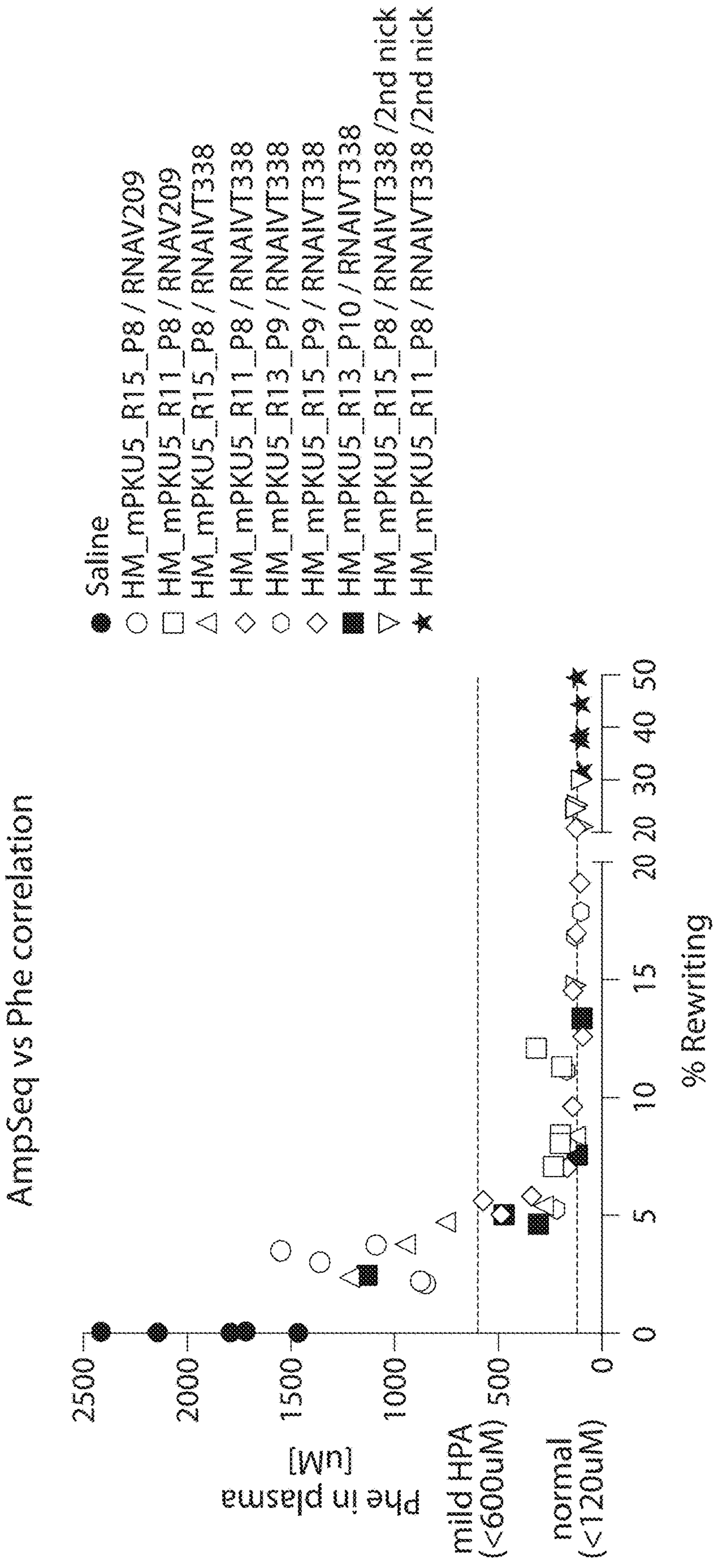
FIG. 22 is a graph showing the level of phenylalanine (Phe) in the plasma versus percent rewriting in samples obtained from mice treated with various gene modifying systems.

Across in vivo murine samples, percent rewriting observed in liver samples should correlate inversely with Phe plasma levels if a gene modifying system is effectively correcting a PAH-inactivating, hyperphenylalaninemia (HPA)-inducing mutation. To confirm this, Phe level in plasma samples was plotted over % rewriting for all plasma and liver samples obtained from treated ENU2 mice (FIG. 22). The results show a clear inverse correlation; as % rewriting increases, plasma Phe levels decrease. Plotted as dotted lines are literature-recognized physiologically normal Phe levels and mild-HPA Phe levels in mice (see, e.g., Ahmed et al. Mol Ther Methods Clin Dev. 2020 Mar. 13; 17:568-580 or Bruinenberg et al. Front Behav Neurosci. 2016; 10: 233). The results show that treatment with nearly all combinations of gene modifying polypeptides, template RNAs, and second strand-targeting gRNAs reduce Phe levels to below mild HPA levels and to normal Phe levels in many cases.

Example 9: Evaluating Safety and Efficacy of Exemplary Template RNAs and Gene Modifying Polypeptides that Insert a Silent Mutation in a Primate PAH Gene in Non-Human Primate Model Animals This example describes the use of exemplary gene modifying systems containing an exemplary gene modifying polypeptide (e.g., RNAIVT338, described above), exemplary template RNA (e.g., described in Tables 4A-4D), and optionally an exemplary second strand-nicking gRNA (e.g., described in Tables 4A-4D) to demonstrate the safety of the gene modifying systems, translation activity of the gene modifying polypeptide, and rewriting activity in a group of non-human primates (NHPs). In some embodiments, the NHPs are Cynomolgus macaques. In some embodiments, the NHPs are Rhesus macaques.

One, two, or more studies are performed. The studies treat NHPs using exemplary gene modifying systems and determine the safety of administration of the systems and/or evaluate the efficacy of the gene modifying system (e.g., percent rewriting, writing accuracy (e.g., indel and imperfect rewriting), and/or phenotypic correction (e.g., PAH protein/mRNA expression and/or plasma Phe level)).

NHPs are distributed into two treated groups, with at least 3 individuals per treated group. Pre-dosing liver biopsy samples are taken at approximately 7 days pre-dosing. Doses of gene modifying system containing mRNA encoding RNAIVT338, exemplary template RNA, and optionally exemplary second strand-nicking gRNA are formulated in LNPs, combined at 1:1 (w/w) of template RNA and mRNA (and optionally 1:1:1 w/w/w of template RNA, mRNA, and gRNA). On Day 1, a single dose is administered intravenously at 3 mg/kg. A single-dose liver biopsy sample is collected from treated individuals one week after the single dose (Day 8). One week after the single-dose liver biopsy sample is taken, the multi-dose phase of the study begins, with two or more (e.g., three) additional doses administered on an alternating day schedule (e.g., on days 15, 17, and 19). A multi-dose liver biopsy sample is collected from treated individuals one week after the last dose of the multi-dose phase (e.g., day 26).

Liver samples are analyzed by Amp-Seq to determine % rewriting, LC/MS to determine Phe levels, and/or immunohistochemistry (e.g., in situ hybridization and/or Western blot) to determine expression of the exemplary gene modifying polypeptide. Plasma samples are obtained from blood draws at each biopsy time point, as well as at shorter time points (e.g., less than 7 days post-dosing). Plasma samples are analyzed, e.g., by LC/MS, for Phe levels. Rewriting will be observed in liver cells after a single dose, with increasing rewriting % observed after multiple doses are administered. Plasma Phe levels will be observed to decrease after a single dose, with more significant decreases observed after multiple doses are administered and correlating with rewriting %.

Example 10: Demonstrating Use of Different Exemplary Template RNA Spacers to Target *Macaca fascicularis* PAH Gene This example describes the use of exemplary gene modifying systems containing a gene modifying polypeptide and template RNAs comprising one of four different gRNA spacer sequences combined with a variety of heterologous object sequences and PBS sequences to induce a series of phenylketonuria relevant genetic alterations in HEK293T cells modified to contain a *Macaca fascicularis* PAH gene. This example demonstrates gene modification to:

(1) Introduce a silent C to A mutation in the codon homologous to that encoding human R408 (CtoA)

(2) Introduce the C to A mutation of (1) and additionally a PAM/seed killing mutation that inhibits retargeting by the gene modifying polypeptide after editing (CtoA+PSkill).

(3) Introduce the C to A mutation of (1) and additional silent substitutions promoting favorable DNA repair incorporating the C to A mutation (CtoA+subs).

(4) Introduce a T to C mutation, similar to that needed to correct PKU-associated R408W in human PAH (TtoC).

In this example, a template RNA contained:

(1) a gRNA spacer;

(2) a gRNA scaffold;

(3) a heterologous object sequence; and (4) a primer binding site (PBS) sequence.

Exemplary template RNAs contained one of the following four spacer sequences:

```
cPKU4:
                    (SEQ ID NO: 30481)
GGGUCAUAGCGAACUGAGAA

cPKU5.1:
                    (SEQ ID NO: 30482)
UAGCGAACUGAGAAGGGCCG

cPKU5.2:
                    (SEQ ID NO: 30483)
AGCGAACUGAGAAGGGCCGA

cPKU6:
                    (SEQ ID NO: 30484)
ACUUUGCUGCCACAAUCCCU
```

The exemplary gene modifying polypeptide was RNA-IVT338 (described in Example 8).

mRNA encoding RNAIVT338 and template RNA were transfected into HEK293T cells containing a genomic modification which inserted the *M fascicularis* PAH gene. After transfection, HEK293T cells were cultured for at least 4 days and then assayed for rewriting by isolating genomic DNA, conducting PCR using primers flanking the *M fascicularis* PAH gene, and then sequencing the amplicons using Amp-Seq.

Figure 23:
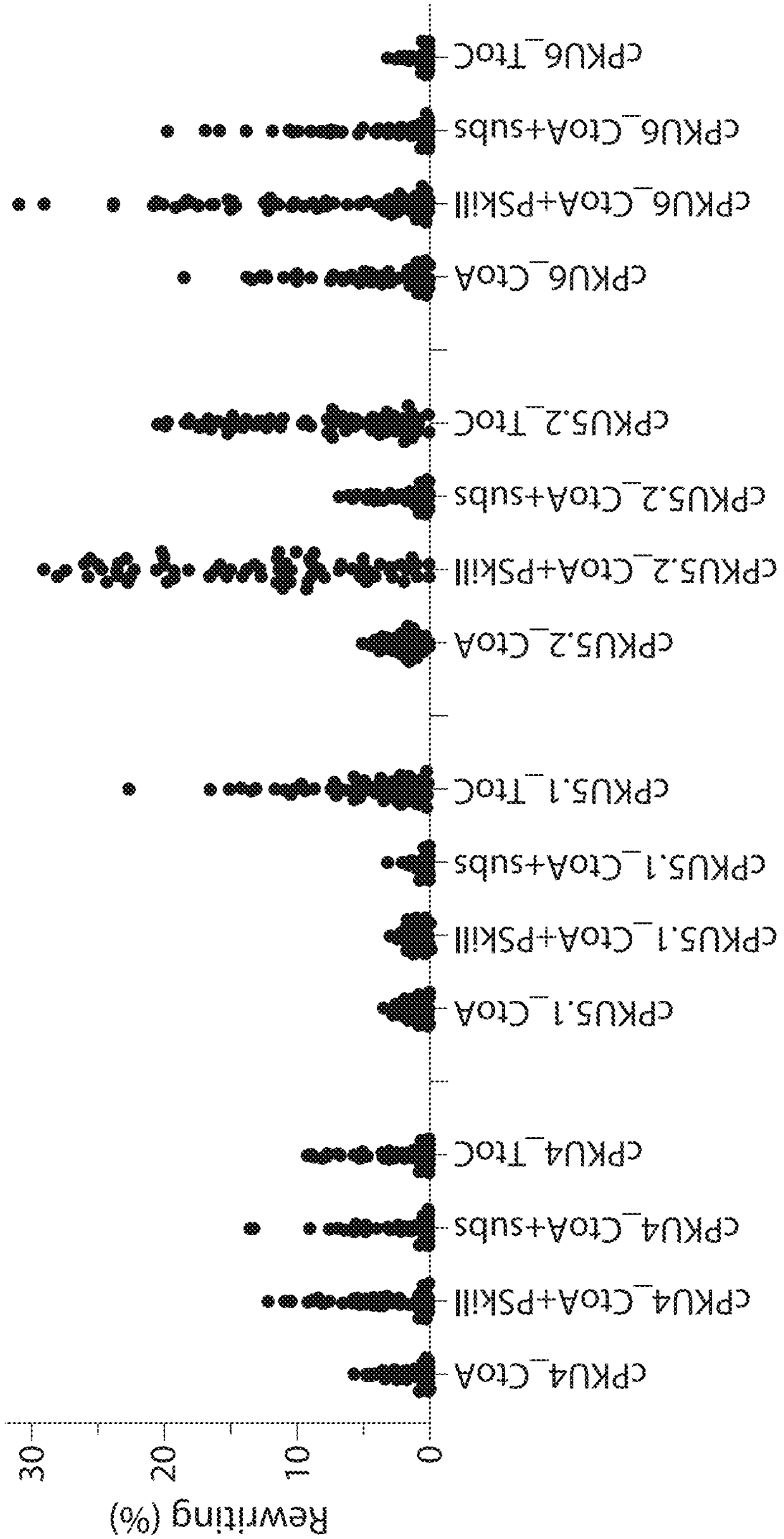
FIG. 23 is a graph showing percent rewriting in HEK293T cells containing the *M fascicularis* PAH gene for four different mutation types using template RNAs containing four different spacer sequences.

FIG. 23 shows a graph of percent rewriting for the 4 different mutation types using the template RNAs containing the four spacer sequences under evaluation (where each dot represents that column's spacer combined with a particular of RT and PBS sequence). CtoA, CtoA+PSkill, CtoA+subs, and TtoC mutations were observed when utilizing each of the spacer sequences tested, but with different rewriting % levels. For example: a large number of template RNAs containing spacer cPKU5.2 yielded high rewriting % for CtoA+PSkill mutation and TtoC mutation; a large number of template RNAs containing spacer cPKU6 yielded high rewriting % for CtoA, CtoA+PSkill, and CtoA+subs mutations; a large number of template RNAs containing spacer cPKU5.2 yielded high rewriting % for CtoA+PSkill and CtoA+subs mutations. The results show that gene modifying systems comprising an exemplary gene modifying polypeptide and template RNAs containing four different exemplary spacer sequences enabled 4 different PKU-relevant genetic modifications to a primate PAH gene.

Example 11: Evaluating Template RNA/Second Strand-Targeting gRNA Dose Response in Correction of an F263S Mutation in a Murine Pah Gene in Murine Model Animals This example describes the use of exemplary gene modifying systems containing a gene modifying polypeptide, either of two template RNAs (each comprising different spacers, lengths and compositions of heterologous object sequences, and PBS sequences), and a second strand-targeting gRNA to evaluate the dose response of template RNA and second strand-targeting gRNA level to rewriting activity (the correction of an F263S mutation (corresponding to a T835C base change) in the murine Pah gene). Two different concentrations of template RNA and second strand-targeting gRNA (1.2 milligrams per kilogram body weight (mpk) and 2.4 mpk) were evaluated. In this example, a template RNA contained:

(1) a gRNA spacer;

(2) a gRNA scaffold;

(3) a heterologous object sequence; and (4) a primer binding site (PBS) sequence.

Exemplary template RNAs tested were template RNAs RNACS1855 and RNACS2303, shown in Table E1. The exemplary second strand-targeting gRNA was ngRNA5 (also referred to herein as RNACS2101), shown in Table E2. The exemplary gene modifying polypeptide used was RNA-IVT338 (as described above and corresponding to the amino acid sequence of SEQ ID NO: 30480.

The gene modifying system was formulated in LNP and delivered to mice. Specifically, 1.2 or 2.4 mpk of total RNA equivalent formulated in LNPs, combined at 1:1 (w/w) of template RNA and mRNA or 1:1:1 (w/w/w) when including ngRNA, were dosed intravenously in 8 to 10-week-old, mixed gender ENU2 mice (0.8 mg/kg each of template RNA and mRNA, optionally with an additional 0.8 mg/kg of ngRNA for second strand-targeting experiments; or 0.4 mg/kg each of template RNA and mRNA, optionally with an additional 0.4 mg/kg of ngRNA for second strand-targeting experiments) in a 10 ml/kg bolus. Mice were administered a first dose at time 0 (t=0) and a second dose 24 hours later (t=24). 7 days post-dosing, animals were sacrificed, and their liver and plasma collected for analyses.

Figure 24B:
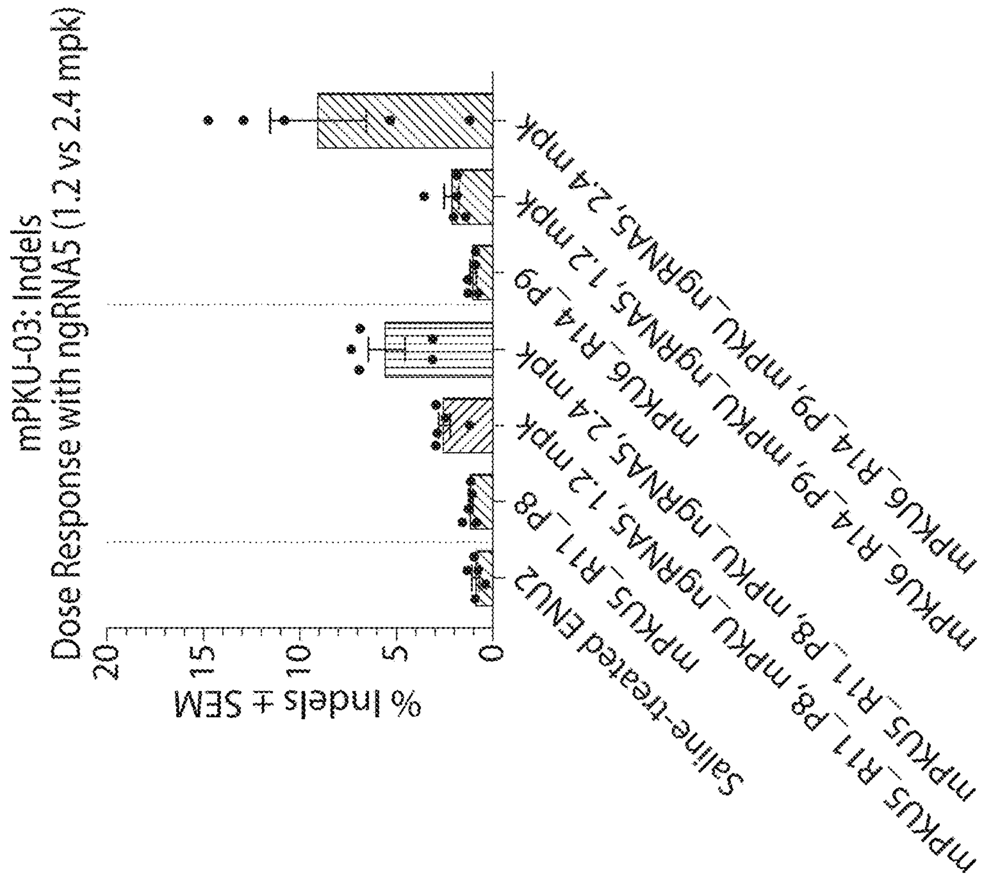
FIGS. 24A-24C are graphs showing percent rewriting (FIG. 24A) and percent indels (FIG. 24B) in mouse liver cells, or concentration of Phe in plasma (FIG. 24C) days post-dosing with LNPs comprising various gene modifying systems.
Figure 24A:
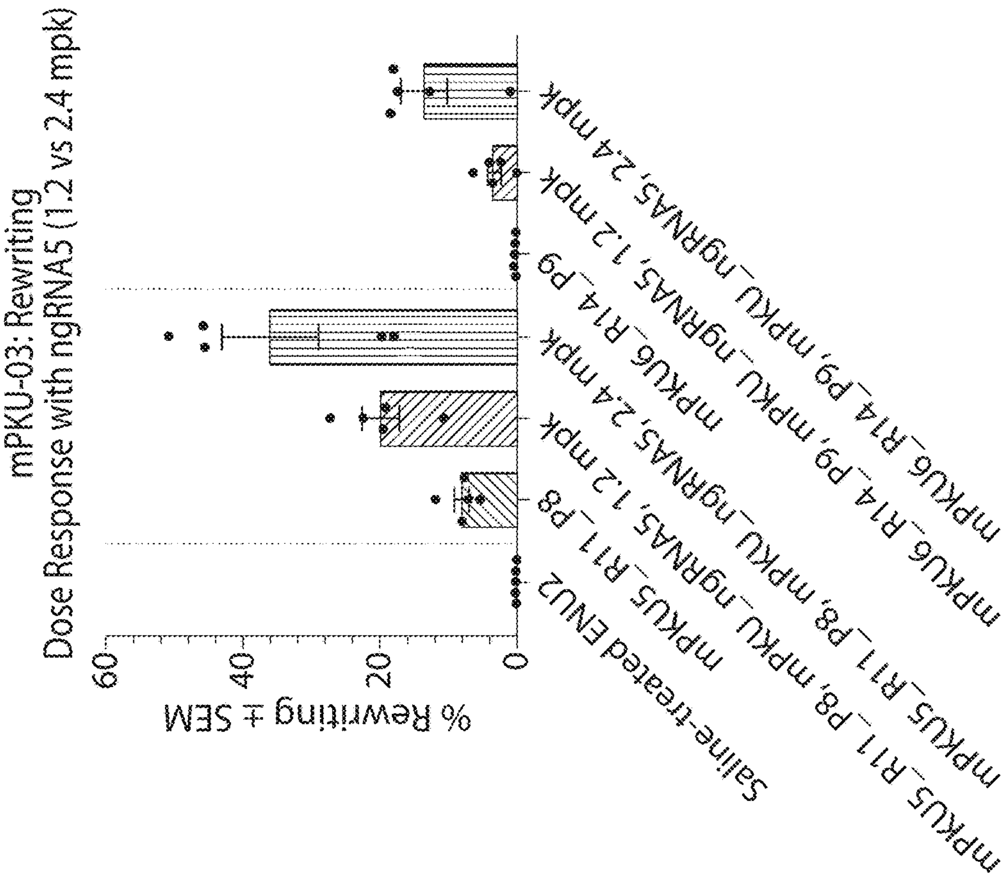

7-day liver samples were analyzed using Amp-Seq to determine % rewriting in target liver cells (FIG. 24A). To analyze gene editing activity, primers flanking the target insertion site locus were used to amplify across the locus in the genomic DNA of liver samples. Amplicons were analyzed via short read sequencing using an Illumina MiSeq. Conversion of a C nucleotide to a T nucleotide at position 835 in the PAH gene indicates successful editing. Rewriting was observed from all treated mice except for RNACS2303 without second strand-targeting gRNA. This is consistent with the interpretation that RNACS2303 is less effective at facilitating rewriting at this locus than RNACS1855 in the absence of a second strand-targeting gRNA, and that the presence of a second strand-targeting gRNA increases rewriting activity. As the dose of template RNA and second strand-targeting gRNA increased, so did the % rewriting. This suggests that the amount of template RNA and/or second strand-targeting gRNA can be adjusted to achieve a desired (e.g., sufficient) level of rewriting activity corresponding to a therapeutic outcome. Amplicon sequencing was also used to evaluate the degree to which INDELs were introduced into the liver sample DNA (FIG. 24B). % INDEL increased with template RNA and second strand-targeting gRNA dosage, correlating with % rewriting. The results suggest that the amount of template RNA and/or second strand-targeting gRNA can be adjusted to decrease (e.g., minimize) the % INDEL while achieving a desired (e.g., sufficient) level of rewriting activity corresponding to a therapeutic outcome.

7-day plasma samples were also analyzed by LC/MS to determine the level of phenylalanine present. ENU2 mice harbor a mutation (F263S) in the murine PAH gene that inactivates the PAH enzyme, resulting in sharply higher Phe levels in plasma than healthy wildtype mice. The ENU2 mutation is described by The Jackson Laboratory (jax.org/strain/002232) as a T835C missense mutation in the murine PAH gene, however the mutation is also described in the literature as being a T788C mutation (see, e.g., Harding, C. O. Mol Front J. 2019 December; 3(2):110-121; or Pecimonova, M. Genes (Basel). 2019 Jun. 15; 10(6):459). The Examples explicitly contemplate both positions whenever reference is made to either nucleotide mutation herein. Phenylalanine was extracted from mouse plasma using protein precipitation and then analyzed by a LC-MS/MS system equipped with a Shimadzu Nexera UPLC (LC-40) coupled to a Sciex API 7500 mass spectrometer. Surrogate analyte (13C2,15N-Phenylalanine) was used for phenylalanine quantitation. Equivalence of ionization for naturally occurring and surrogate compounds was established prior to and after analytical run. Data were collected in the positive ion mode with three MRM transitions, 169.1 to 123.1 (13C2,15N-Phenylalanine), 166.1 to 120.1 (Phenylalanine) and 172.1 to 126.0 (13C6-Phenylalanine, internal standard). Extracted samples were injected onto an Acquity UPLC BEH C18 column (1.7 μm, 2.1×50 mm) and eluted using a gradient of 0% to 15% of mobile phase B at a flow rate of 0.8 mL/min with a total run time of 3 min per injection. Mobile phase A is 100:2:0.1 H2O:Formic acid (FA): Trifluoroacetic acid (TFA) and mobile phase B is 95:5:2:0.1 ACN:H2O:FA:TFA. Data were processed using Sciex OS software.

Figure 24C:
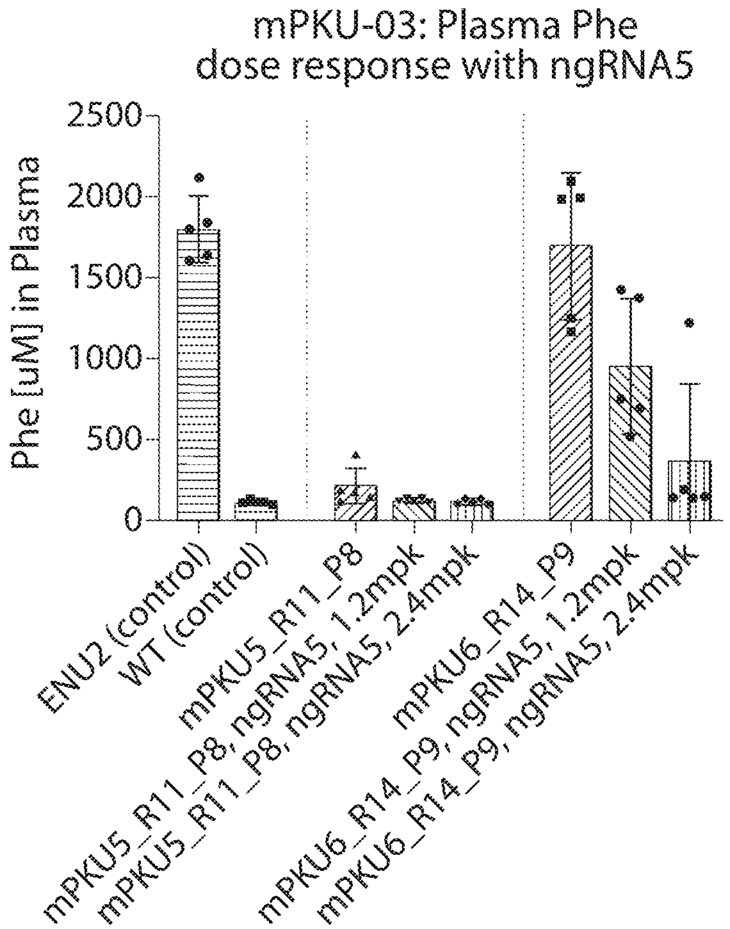

The results showed that Phe levels decreased in plasma from all treated mice except for RNACS2303 without second strand-targeting gRNA. This is consistent with the interpretation that RNACS2303 is less effective at facilitating rewriting at this locus than RNACS1855 in the absence of a second strand-targeting gRNA, and that the presence of a second strand-targeting gRNA increases rewriting activity. The results are consistent with correction of the PAH deactivating point mutation using the exemplary gene modifying polypeptide and either of the template RNAs examined (FIG. 24C). Treatment with LNP containing RNACS1855 decreased Phe levels more than treatment with LNP containing RNACS2303. Addition of a second strand-targeting gRNA and increasing the dosage of template RNA and second strand-targeting gRNA caused Phe levels to decrease more precipitously in RNACS2303 treated samples. The addition of a second strand-targeting gRNA and increasing the dosage of template RNA and second strand-targeting gRNA caused only small additional Phe levels decreases in RNACS1855 treated samples. These results suggest that a higher dose and/or second strand-targeting gRNA may be necessary to reduce plasma Phe levels to wild-type levels for some template RNAs, but that for highly effective template RNAs a lower dose or omission of second strand-targeting gRNA may be sufficient to reduce plasma Phe to wild-type levels. When considered together (FIGS. 24A-24C), the results show that increasing the template RNA and second strand-targeting gRNA dose increases the % rewriting, as well as % INDEL, and that for highly effective template RNAs a lower dose or omission of second strand-targeting gRNA (despite lower % rewriting) provides a nearly wild-type plasma Phe phenotype.

Example 12: Evaluating Rewriting Activity of Exemplary Human Template RNAs in hPAH Mice This example describes the use of exemplary gene modifying systems containing a gene modifying polypeptide and template RNAs comprising varied spacers, lengths and compositions of heterologous object sequences, and PBS sequences to quantify the activity of template RNAs for correction of an R408W mutation (corresponding to a C>T base change) in a human PAH (hPAH) gene in vivo in mice modified to carry R408W hPAH.

In this example, a template RNA contained:

(1) a gRNA spacer;

(2) a gRNA scaffold;

(3) a heterologous object sequence; and (4) a primer binding site (PBS) sequence.

Exemplary template RNAs generated are given in Table E3. Nucleotide modifications are noted as follows: phosphorothioate linkages denoted by an asterisk, 2'-O-methyl groups denoted by an 'm' preceding a nucleotide. The exemplary gene modifying polypeptide is RNAIVT338, comprising the amino acid sequence of SEQ ID NO: 30480.

TABLE E3

Exemplary Template RNAs and Sequences

| RNACS | Name | Sequence | SEQ ID NO |
|---|---|---|---|
| RNACS 4047 | hPKU3_R 17_P9 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrC*mG*mC*mU | 30485 |
| RNACS 1747 | hPKU3_R 19_P9 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrUrC*mG*mC*mU | 30486 |
| RNACS 3878 | hPKU4_R 16_P9 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrU*mC*mG*mC | 30487 |
| RNACS 3877 | hPKU4_R 16_P10 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrC*mG*mC*mU | 30488 |
| RNACS 4135 | hPKU5_R 10_P9 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrC*mU*mC*mA | 30489 |

TABLE E3-continued

| RNACS | Name | Sequence | SEQ ID NO |
|---|---|---|---|
| Exemplary Template RNAs and Sequences | | | |
| RNACS 4134 | hPKU5_R 10_P10 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrU*mC*mA*mG | 30490 |
| RNACS 2300 | hPKU5_R 10_P11 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrC*mA*mG*mU | 30491 |
| RNACS 2299 | hPKU5_R 12_P10 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrU*mC*mA*mG | 30492 |
| RNACS 4142 | hPKU5_R 12_P11 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrC*mA*mG*mU | 30493 |
| RNACS 4173 | hPKU5_R 18_P8 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrGrCrCrCrUrU*mC*mU*mC | 30494 |
| RNACS 4045 | hPKU3_R 17_P11 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrCrGrC*mU*mA*mC | 30495 |
| RNACS 4048 | hPKU3_R 17_P8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrU*mC*mG*mC | 30496 |
| RNACS 1763 | hPKU4_R 18_P9 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrU*mC*mG*mC | 30497 |
| RNACS 3907 | hPKU4_R 22_P9 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrGrCrCrCrUrUrCrUrCrArGrUrU*mC*mG*mC | 30498 |
| RNACS 3643 | hPKU6_R 11_P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrCrCrGrArGrGrUrArUrUrGrUrGrG*mC*mA*mG | 30499 |
| RNACS 1792 | hPKU6_R 9_P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrGrGrCrCrGrArGrGrUrArUrUrGrUrGrG*mC*mA*mG | 30500 |

Table E3A shows the sequences of E3 without chemical modifications. In some embodiments, the sequences of Table E3A may be used without chemical modifications, or with one or more chemical modifications.

TABLE E3A

| RNACS | Name | Sequence | SEQ ID NO |
|---|---|---|---|
| Table E3 Sequences without Chemical Modifications | | | |
| RNACS4047 | hPKU3_R17_P9 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGCU | 37206 |
| RNACS1747 | hPKU3_R19_P9 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGCU | 37207 |

TABLE E3A-continued

Table E3 Sequences without Chemical Modifications

| RNACS | Name | Sequence | SEQ ID NO |
|---|---|---|---|
| RNACS3878 | hPKU4_R16_P9 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGC | 37208 |
| RNACS3877 | hPKU4_R16_P10 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGCU | 37209 |
| RNACS4135 | hPKU5_R10_P9 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCA | 37210 |
| RNACS4134 | 0_P10 hPKU5_R1 | UGAAAAAGUGGCACCGAGUCGGUGCAAUACCUCGGCCCUUCUCAG UAGCGAACUGAGAAGGGCCAGUUUUAGAGCUAGAAAUAGCAAGUUAAAAUAAGGCUAGUCCGUUAUCAACU | 37211 |
| RNACS2300 | hPKU5_R10_P11 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGU | 37212 |
| RNACS2299 | hPKU5_R12_P10 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAG | 37213 |
| RNACS4142 | hPKU5_R12_P11 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGU | 37214 |
| RNACS4173 | hPKU5_R18_P8 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCGCUGCCACAAUACCUCGGCCCUUCUC | 37215 |
| RNACS4045 | hPKU3_R17_P11 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGCUAC | 37216 |
| RNACS4048 | hPKU3_R17_P8 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGC | 37217 |
| RNACS1763 | hPKU4_R18_P9 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGC | 37218 |
| RNACS3907 | hPKU4_R22_P9 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCUGCCACAAUACCUCGGCCCUUCUCAGUUCGC | 37219 |
| RNACS3643 | hPKU6_R11_P11 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAAGGGCCGAGGUAUUGUGGCAG | 37220 |
| RNACS1792 | hPKU6_R9P11 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGGGCCGAGGUAUUGUGGCAG | 37221 |

The gene modifying system comprising RNAIVT338 gene modifying polypeptide and a template RNA described above were formulated in LNP and delivered to mice. Specifically, approximately 1.6 mg/kg of total RNA equivalent formulated in LNPs (4:1 N:P ratio for mRNA, and 3:1 N:P ratio for tgRNA), combined at 1:1 (w/w) of template RNA and mRNA, were dosed intravenously in 8 to 10-week-old, mixed gender hPAH mice (0.8 mg/kg each of template RNA and mRNA) in a 10 ml/kg bolus. Mice were administered a dose at time 0 (t=0). 7 days post-dosing (as used herein post-dosing refers to time since the first dose), animals were sacrificed, and their liver and plasma are collected for analyses.

7-day plasma samples were analyzed by LC/MS to determine the level of phenylalanine present. hPAH trangenic mice harbor a mutation in the human PAH gene that inactivates the PAH enzyme, resulting in sharply higher Phe levels in plasma than healthy wildtype mice. Successful rewriting of the hPAH transgene would be expected to result in a decrease in Phe levels in plasma.

Phenylalanine was extracted from mouse plasma using protein precipitation and was analyzed by a LC-MS/MS system equipped with a Shimadzu Nexera UPLC (LC-40) coupled to a Sciex API 7500 mass spectrometer. Surrogate analyte (13C2,15N-Phenylalanine) was used for phenylalanine quantitation. Equivalence of ionization for naturally occurring and surrogate compounds was established prior to and after analytical run. Data were collected in the positive ion mode with three MRM transitions, 169.1 to 123.1 (13C2,15N-Phenylalanine), 166.1 to 120.1 (Phenylalanine) and 172.1 to 126.0 (13C6-Phenylalanine, internal standard). Extracted samples were injected onto an Acquity UPLC BEH C18 column (1.7 μm, 2.1×50 mm) and eluted using a gradient of 0% to 15% of mobile phase B at a flow rate of 0.8 mL/min with a total run time of 3 min per injection. Mobile phase A was 100:2:0.1 H2O:Formic acid (FA): Trifluoroacetic acid (TFA) and mobile phase B was a 95:5:2:0.1 ACN:H2O:FA:TFA. Data were processed using Sciex OS software.

Figure 35:
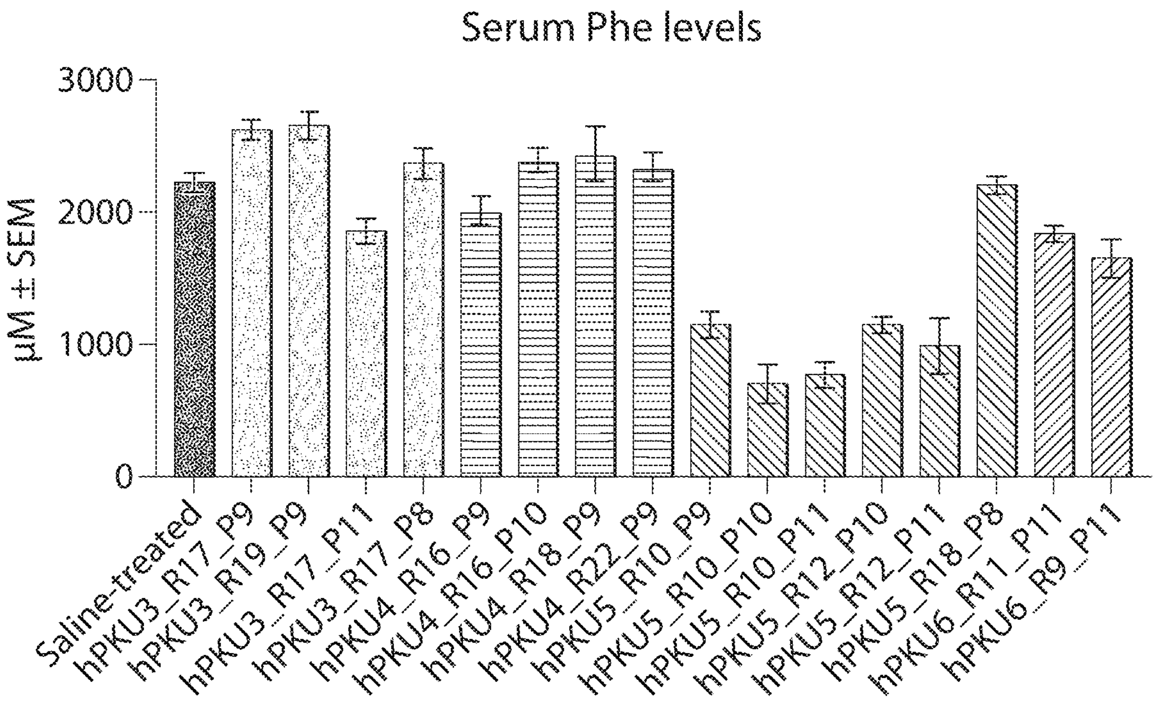
FIG. 35 is a graph showing serum levels of Phe in mice following treatment with LNPs comprising various gene modifying systems.

FIG. 35 shows a graph of Phe levels in plasma from treated mice. The results show that Phe levels decreased in hPAH mice treated with exemplary gene modifying systems. The results further showed that Phe levels decreased most in mice treated with hPKU5 template RNAs, with RNACS4134 showing the steepest decrease in Phe levels. These results show that exemplary gene modifying systems targeting mutant hPAH in vivo can achieve editing that results in clinically-relevant phenotype changes.

7-day liver samples were analyzed using Amp-Seq to determine % rewriting and % INDELs in target liver cells. To analyze gene editing activity, primers flanking the target insertion site locus were used to amplify across the locus in the genomic DNA of liver samples. Amplicons were analyzed via short read sequencing using an Illumina MiSeq. Conversion of a C nucleotide to a T nucleotide at position 1222 in exon 12 in the human PAH gene indicated successful editing.

Figure 36A:
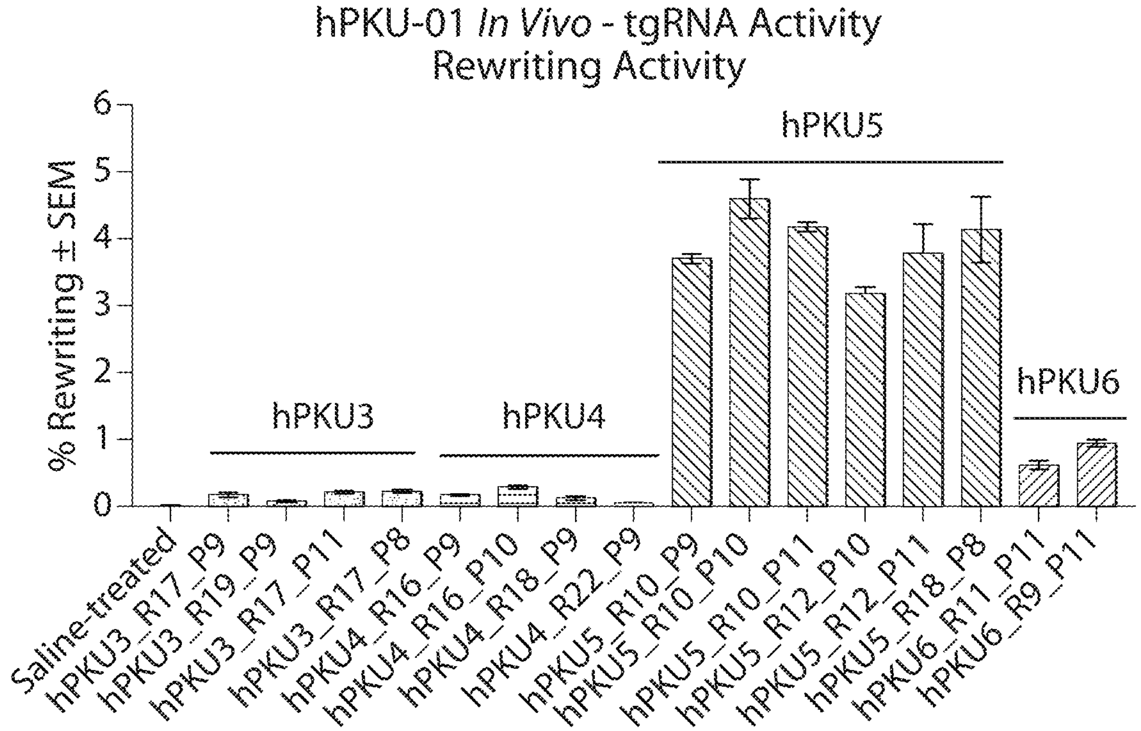
FIGS. 36A-36B are graphs showing percent rewriting (FIG. 36A) and percent indels (FIG. 36B) in mouse liver following treatment with LNPs comprising various gene modifying systems.
Figure 36B:
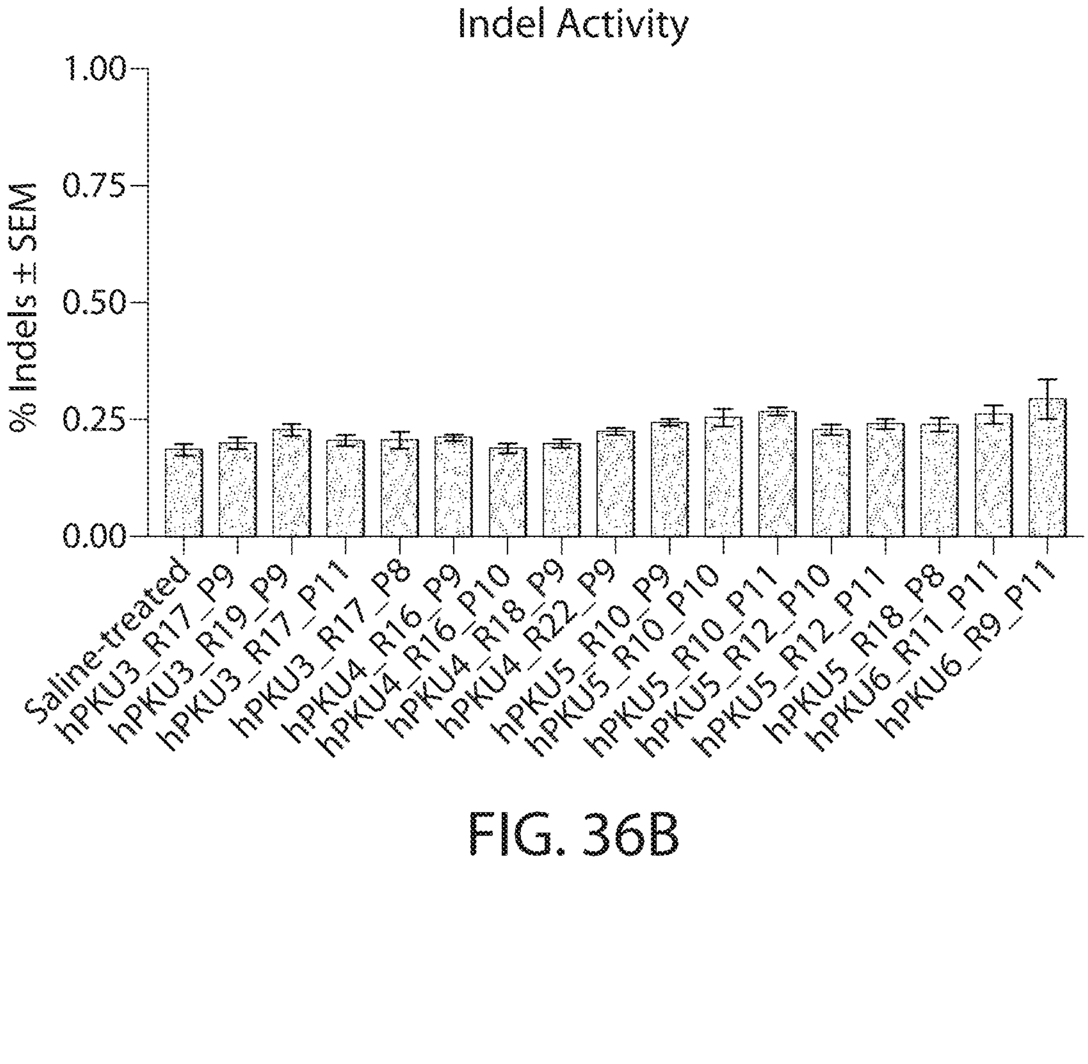

FIG. 36A shows a graph of % rewriting level for each of the tested template RNAs. The results showed that hPKU5-spacer-containing template RNAs showed the highest rewriting activity, with RNACS4134 showing the highest rewriting activity of about 4.6%. FIG. 36B shows a graph of % INDEL activity for each of the tested template RNAs. The results showed that all tested template RNAs had very low levels of INDEL generation in hPAH in mouse liver cells, including hPKU5 template RNAs. The results show that exemplary gene modifying systems can be used to specifically correct a clinically relevant mutation in hPAH in vivo in mice.

Example 13: Evaluating Rewriting Activity of Exemplary Human Template RNAs and Second Strand-Targeting gRNAs in Several Cellular Systems This example describes the use of exemplary gene modifying systems containing a gene modifying polypeptide, template RNAs comprising varied spacers, lengths and compositions of heterologous object sequences, and PBS sequences, and either of two second strand-targeting gRNAs to evaluate the activity of template RNAs and second strand-targeting gRNAs to: 1) produce a R408W mutation into wild-type hPAH in primary human hepatocytes, 2) produce an W408R mutation to correct the R408W mutation in hPAH in CRISPR gene-edited iPSC hepatoblast cells, and 3) produce an W408R mutation to correct the R408W mutation in hPAH transgenic mice (described in Example 12). Combinations of template RNAs and second strand-targeting gRNAs (e.g., sequences, e.g., spacer sequences) that provide high rewriting activity in one or more of (1)-(3) may also provide rewriting activity in therapeutic template RNAs and second strand-targeting gRNAs designed for correcting pathogenic hPAH mutations in a human subject.

In this example, a template RNA contained:

(1) a gRNA spacer;

(2) a gRNA scaffold;

(3) a heterologous object sequence; and (4) a primer binding site (PBS) sequence.

Exemplary template RNAs generated and used in iPSC hepatoblast cells and to be used in hPAH transgenic mice are given in Table E5. Exemplary template RNAs generated for use in primary human hepatocytes are given in Table E4. Nucleotide modifications are noted as follows: phosphorothioate linkages denoted by an asterisk, 2'-O-methyl groups denoted by an 'm' preceding a nucleotide. The exemplary gene modifying polypeptide is RNAIVT338, comprising the amino acid sequence of SEQ ID NO: 30480. Exemplary second strand-targeting gRNAs for use with hPKU3, hPKU4, and hPKU5 template RNAs are RNACS1809 and RNACS1810, whereas exemplary second strand-targeting gRNAs for use with hPKU6 template RNAs are RNACS1812, RNACS1834, and RNACS1831, the nucleic acid sequence and chemical modifications of which are given here.

RNACS1809: (SEQ ID NO: 30501)
mG*mU*mG*rCrCrCrUrUrCrArCrUrCrArArGrCrCrUrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCmU*mU*mU*mU

RNACS1810: (SEQ ID NO: 30502)
mU*mU*mC*rArCrUrCrArArGrCrCrUrGrUrGrGrUrUrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCmU*mU*mU*mU

RNACS1812: (SEQ ID NO: 30503)
mG*mU*mC*rCrArArGrArCrCrUrCrArArUrCrCrUrUrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCmU*mU*mU*mU

RNACS1834: (SEQ ID NO: 30504)
mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCmU*mU*mU*mU

RNACS1831: (SEQ ID NO: 30505)
mU*mG*mA*rGrArArGrGrGrCrCrGrArGrGrUrArUrUrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCmU*mU*mU*mU

Unmodified versions of these sequences are shown in Table BB below. In some embodiments, the sequences used in this table can be used without chemical modifications.

TABLE BB

RNACS1809, RNACS1810, RNACS1812, RNACS1834, and RNACS1831 without nucleotide modifications.

| Name | Sequence | SEQ ID NO |
|---|---|---|
| RNAC S1809 | GUGCCCUUCACUCAAGCCUG<br>GUUUUAGAGCUAGAAAUAGC<br>AAGUUAAAAUAAGGCUAGUC<br>CGUUAUCAACUUGAAAAAGU<br>GGCACCGAGUCGGUGCUUUU | 37222 |
| RNAC S1810 | UUCACUCAAGCCUGUGGUUU<br>GUUUUAGAGCUAGAAAUAGC<br>AAGUUAAAAUAAGGCUAGUC<br>CGUUAUCAACUUGAAAAAGU<br>GGCACCGAGUCGGUGCUUUU | 37223 |
| RNAC S1812 | GUCCAAGACCUCAAUCCUUU<br>GUUUUAGAGCUAGAAAUAGC<br>AAGUUAAAAUAAGGCUAGUC<br>CGUUAUCAACUUGAAAAAGU<br>GGCACCGAGUCGGUGCUUUU | 37224 |
| RNAC S1834 | UAGCGAACUGAGAAGGGCCA<br>GUUUUAGAGCUAGAAAUAGC<br>AAGUUAAAAUAAGGCUAGUC<br>CGUUAUCAACUUGAAAAAGU<br>GGCACCGAGUCGGUGCUUUU | 37225 |
| RNAC S1831 | UGAGAAGGGCCGAGGUAUUG<br>GUUUUAGAGCUAGAAAUAGC<br>AAGUUAAAAUAAGGCUAGUC<br>CGUUAUCAACUUGAAAAAGU<br>GGCACCGAGUCGGUGCUUUU | 37226 |

TABLE E4

Exemplary Template RNAs and Sequences for Mutation Installation

| RN ACS # | Name | Sequence | SEQ ID NO |
|---|---|---|---|
| | hPKU 4_R18 P9 | mG*mG*mG*rUrCrGrUrArGrCrGrArArCrUrGrArGrArArGrUrUrUrUrArGrAmGmCmUmAmGmA<br>mAmAmUmAmGmCrArArGrUrUrArArArArUrArArGrGrCrUrArGrUrCrCrGrUrUrArUrCrAmAm<br>CmUmUmGmAmAmAmAmAmGmUmGmGmCmAmCmCmGmAmGmUmCmGmGmUmGmCrArCrArArUrArCrCrU<br>rUrGrGrCrCrCrUrUrCrUrCrArGrUrU*mC*mG*mC | 30506 |
| | hPKU 4_R16 P9 | mG*mG*mG*rUrCrGrUrArGrCrGrArArCrUrGrArGrArArGrUrUrUrUrArGrAmGmCmUmAmGmA<br>mAmAmUmAmGmCrArArGrUrUrArArArArUrArArGrGrCrUrArGrUrCrCrGrUrUrArUrCrAmAm<br>CmUmUmGmAmAmAmAmAmGmUmGmGmCmAmCmCmGmAmGmUmCmGmGmUmGmCrArArUrArCrCrUrUrG<br>rGrCrCrCrUrUrCrUrCrArGrUrU*mC*mG*mC | 30507 |
| | hPKU 4_R16 P10 | mG*mG*mG*rUrCrGrUrArGrCrGrArArCrUrGrArGrArArGrUrUrUrUrArGrAmGmCmUmAmGmA<br>mAmAmUmAmGmCrArArGrUrUrArArArArUrArArGrGrCrUrArGrUrCrCrGrUrUrArUrCrAmAm<br>CmUmUmGmAmAmAmAmAmGmUmGmGmCmAmCmCmGmAmGmUmCmGmGmUmGmCrArArUrArCrCrUrUrG<br>rGrCrCrCrUrUrCrUrCrArGrUrUrC*mG*mC*mU | 30508 |
| | hPKU 4_R18 P10 | mG*mG*mG*rUrCrGrUrArGrCrGrArArCrUrGrArGrArArGrUrUrUrUrArGrAmGmCmUmAmGmA<br>mAmAmUmAmGmCrArArGrUrUrArArArArUrArArGrGrCrUrArGrUrCrCrGrUrUrArUrCrAmAm<br>CmUmUmGmAmAmAmAmAmGmUmGmGmCmAmCmCmGmAmGmUmCmGmGmUmGmCrArCrArArUrArCrCrU<br>rUrGrGrCrCrCrUrUrCrUrCrArGrUrUrC*mG*mC*mU | 30509 |
| | hPKU 4_R18 P11 | mG*mG*mG*rUrCrGrUrArGrCrGrArArCrUrGrArGrArArGrUrUrUrUrArGrAmGmCmUmAmGmA<br>mAmAmUmAmGmCrArArGrUrUrArArArArUrArArGrGrCrUrArGrUrCrCrGrUrUrArUrCrAmAm<br>CmUmUmGmAmAmAmAmAmGmUmGmGmCmAmCmCmGmAmGmUmCmGmGmUmGmCrArCrArArUrArCrCrU<br>rUrGrGrCrCrCrUrUrCrUrCrArGrUrUrCrG*mC*mU*mA | 30510 |
| | hPKU 4_R18 P8 | mG*mG*mG*rUrCrGrUrArGrCrGrArArCrUrGrArGrArArGrUrUrUrUrArGrAmGmCmUmAmGmA<br>mAmAmUmAmGmCrArArGrUrUrArArArArUrArArGrGrCrUrArGrUrCrCrGrUrUrArUrCrAmAm<br>CmUmUmGmAmAmAmAmAmGmUmGmGmCmAmCmCmGmAmGmUmCmGmGmUmGmCrArCrArArUrArCrCrU<br>rUrGrGrCrCrCrUrUrCrUrCrArGrU*mU*mC*mG | 30511 |
| | hPKU 4_R20 P9 | mG*mG*mG*rUrCrGrUrArGrCrGrArArCrUrGrArGrArArGrUrUrUrUrArGrAmGmCmUmAmGmA<br>mAmAmUmAmGmCrArArGrUrUrArArArArUrArArGrGrCrUrArGrUrCrCrGrUrUrArUrCrAmAm<br>CmUmUmGmAmAmAmAmAmGmUmGmGmCmAmCmCmGmAmGmUmCmGmGmUmGmCrCrCrArCrArArUrArC<br>rCrUrUrGrGrCrCrCrUrUrCrUrCrArGrUrU*mC*mG*mC | 30512 |
| | hPKU 4_R24 P9 | mG*mG*mG*rUrCrGrUrArGrCrGrArArCrUrGrArGrArArGrUrUrUrUrArGrAmGmCmUmAmGmA<br>mAmAmUmAmGmCrArArGrUrUrArArArArUrArArGrGrCrUrArGrUrCrCrGrUrUrArUrCrAmAm<br>CmUmUmGmAmAmAmAmAmGmUmGmGmCmAmCmCmGmAmGmUmCmGmGmUmGmCrGrCrUrGrCrCrArCrA<br>rArUrArCrCrUrUrGrGrCrCrCrUrUrCrUrCrArGrUrU*mC*mG*mC | 30514 |
| | hPKU 4_R22 P9 | mG*mG*mG*rUrCrGrUrArGrCrGrArArCrUrGrArGrArArGrUrUrUrUrArGrAmGmCmUmAmGmA<br>mAmAmUmAmGmCrArArGrUrUrArArArArUrArArGrGrCrUrArGrUrCrCrGrUrUrArUrCrAmAm<br>CmUmUmGmAmAmAmAmAmGmUmGmGmCmAmCmCmGmAmGmUmCmGmGmUmGmCrUrGrCrCrArCrArArU<br>rArCrCrUrUrGrGrCrCrCrUrUrCrUrCrArGrUrU*mC*mG*mC | 30515 |

TABLE E4-continued

Exemplary Template RNAs and Sequences for Mutation Installation

| RN ACS # | Name | Sequence | SEQ ID NO |
|---|---|---|---|
| | hPKU3_R17P8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrUrGrGrCrCrCrUrUrCrUrCrArGrUrU*mC*mG*mC | 30516 |
| | hPKU3_R19P8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrUrGrGrCrCrCrUrUrCrUrCrArGrUrU*mC*mG*mC | 30517 |
| | hPKU3_R17P9 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrUrGrGrCrCrCrUrUrCrUrCrArGrUrUrC*mG*mC*mU | 30518 |
| | hPKU3_R17P10 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrUrGrGrCrCrCrUrUrCrUrCrArGrUrUrCrG*mC*mU*mA | 30519 |
| | hPKU3_R19P9 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrUrGrGrCrCrCrUrUrCrUrCrArGrUrUrC*mG*mC*mU | 30520 |
| | hPKU3_R23P8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrUrGrGrCrCrCrUrUrCrUrCrArGrUrU*mC*mG*mC | 30521 |
| | hPKU3_R19P10 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrUrGrGrCrCrCrUrUrCrUrCrArGrUrUrCrG*mC*mU*mA | 30522 |
| | hPKU3_R17P12 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrUrGrGrCrCrCrUrUrCrUrCrArGrUrUrCrGrCrU*mA*mC*mG | 30523 |
| | hPKU3_R17P11 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrUrGrGrCrCrCrUrUrCrUrCrArGrUrUrCrGrC*mU*mA*mC | 30524 |
| | hPKU3_R19P11 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrUrGrGrCrCrCrUrUrCrUrCrArGrUrUrCrGrC*mU*mA*mC | 30525 |
| RNACS3649 | hPKU6_R9P12 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrGrGrCrCrArArGrGrUrArUrUrGrUrGrGrC*mA*mG*mC | 30526 |
| RNACS3650 | hPKU6_R17P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrUrGrArGrArArGrGrGrCrCrArArGrGrUrArUrUrGrUrGrG*mC*mA*mG | 30527 |
| RNACS3651 | hPKU6_R13P9 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArGrArArGrGrGrCrCrArArGrGrUrArUrUrGrU*mG*mG*mC | 30528 |
| RNACS3652 | hPKU6_R11P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrCrCrArArGrGrUrArUrUrGrUrGrG*mC*mA*mG | 30529 |
| RNACS3653 | hPKU6_R15P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrArGrArArGrGrGrCrCrArArGrGrUrArUrUrGrUrGrG*mC*mA*mG | 30530 |

TABLE E4-continued

| Exemplary Template RNAs and Sequences for Mutation Installation | | | |
|---|---|---|---|
| RN ACS # | Name | Sequence | SEQ ID NO |
| RN ACS 3654 | hPKU 6_R13 P10 | mA*mC*mU*rUrUrGrCrUrGrCrCrArCrArArUrArCrCrUrGrUrUrUrUrArGrAmGmCmUmAmGmA mAmAmUmAmGmCrArArGrUrUrArArArArUrArArGrGrCrUrArGrUrCrCrGrUrUrArUrCrAmAm CmUmUmGmAmAmAmAmAmGmUmGmGmCmAmCmCmGmAmGmUmCmGmGmUmGmCrArGrArArGrGrCrC rArArGrGrUrArUrUrGrUrG*mG*mC*mA | 30531 |
| RN ACS 3655 | hPKU 6_R11 P13 | mA*mC*mU*rUrUrGrCrUrGrCrCrArCrArArUrArCrCrUrGrUrUrUrUrArGrAmGmCmUmAmGmA mAmAmUmAmGmCrArArGrUrUrArArArArUrArArGrGrCrUrArGrUrCrCrGrUrUrArUrCrAmAm CmUmUmGmAmAmAmAmAmGmUmGmGmCmAmCmCmGmAmGmUmCmGmGmUmGmCrArArGrGrGrCrCrArA rGrGrUrArUrUrGrUrGrGrCrA*mG*mC*mA | 30532 |
| RN ACS 1799 | hPKU 6_R9P 11 | mA*mC*mU*rUrUrGrCrUrGrCrCrArCrArArUrArCrCrUrGrUrUrUrUrArGrAmGmCmUmAmGmA mAmAmUmAmGmCrArArGrUrUrArArArArUrArArGrGrCrUrArGrUrCrCrGrUrUrArUrCrAmAm CmUmUmGmAmAmAmAmAmGmUmGmGmCmAmCmCmGmAmGmUmCmGmGmUmGmCrGrGrGrCrCrArArGrG rUrArUrUrGrUrGrG*mC*mA*mG | 30533 |
| RN ACS 3656 | hPKU 6_R13 P13 | mA*mC*mU*rUrUrGrCrUrGrCrCrArCrArArUrArCrCrUrGrUrUrUrUrArGrAmGmCmUmAmGmA mAmAmUmAmGmCrArArGrUrUrArArArArUrArArGrGrCrUrArGrUrCrCrGrUrUrArUrCrAmAm CmUmUmGmAmAmAmAmAmGmUmGmGmCmAmCmCmGmAmGmUmCmGmGmUmGmCrArGrArArGrGrCrC rArArGrGrUrArUrUrGrUrGrGrCrA*mG*mC*mA | 30534 |
| RN ACS 3657 | hPKU 6_R11 P9 | mA*mC*mU*rUrUrGrCrUrGrCrCrArCrArArUrArCrCrUrGrUrUrUrUrArGrAmGmCmUmAmGmA mAmAmUmAmGmCrArArGrUrUrArArArArUrArArGrGrCrUrArGrUrCrCrGrUrUrArUrCrAmAm CmUmUmGmAmAmAmAmAmGmUmGmGmCmAmCmCmGmAmGmUmCmGmGmUmGmCrArArGrGrGrCrCrArA rGrGrUrArUrUrGrU*mG*mG*mC | 30535 |

TABLE E5

| Further Exemplary Template RNAs and Sequences for Mutation Correction | | | |
|---|---|---|---|
| RNACS# | Name | Sequence | SEQ ID NO |
| RNACS 4947 | hPKU 5_R12 P10 | mU*mA*mG*rCrGrArArCrUrGrArGrArArGrGrGrCrCrArGrUrUrUrUrArGrAmGmCmUmAmGmAm AmAmUmAmGmCrArArGrUrUrArArArArUrArArGrGrCrUrArGrUrCrCrGrUrUrArUrCrAmAmCm UmUmGmAmAmAmAmAmGmUmGmGmCmAmCmCmGmAmGmUmCmGmGmUmGmCrArCrArArUrArCrCrUrCr GrGrCrCrCrUrUrCrU*mC*mA*mG | 30536 |
| RNACS 2300 | hPKU 5_R10 P11 | mU*mA*mG*rCrGrArArCrUrGrArGrArArGrGrGrCrCrArGrUrUrUrUrArGrAmGmCmUmAmGmAm AmAmUmAmGmCrArArGrUrUrArArArArUrArArGrGrCrUrArGrUrCrCrGrUrUrArUrCrAmAmCm UmUmGmAmAmAmAmAmGmUmGmGmCmAmCmCmGmAmGmUmCmGmGmUmGmCrArArUrArCrCrUrCrGrGr CrCrCrUrUrCrUrC*mA*mG*mU | 30537 |
| RNACS 2301 | hPKU 5_R12 P12 | mU*mA*mG*rCrGrArArCrUrGrArGrArArGrGrGrCrCrArGrUrUrUrUrArGrAmGmCmUmAmGmAm AmAmUmAmGmCrArArGrUrUrArArArArUrArArGrGrCrUrArGrUrCrCrGrUrUrArUrCrAmAmCm UmUmGmAmAmAmAmAmGmUmGmGmCmAmCmCmGmAmGmUmCmGmGmUmGmCrArCrArArUrArCrCrUrCr GrGrCrCrCrUrUrCrUrCrA*mG*mU*mU | 30538 |
| RNACS 4134 | hPKU 5_R10 P10 | mU*mA*mG*rCrGrArArCrUrGrArGrArArGrGrGrCrCrArGrUrUrUrUrArGrAmGmCmUmAmGmAm AmAmUmAmGmCrArArGrUrUrArArArArUrArArGrGrCrUrArGrUrCrCrGrUrUrArUrCrAmAmCm UmUmGmAmAmAmAmAmGmUmGmGmCmAmCmCmGmAmGmUmCmGmGmUmGmCrArArUrArCrCrUrCrGrGr CrCrCrUrUrCrU*mC*mA*mG | 30539 |
| RNACS 4172 | hPKU 5_R18 P10 | mU*mA*mG*rCrGrArArCrUrGrArGrArArGrGrGrCrCrArGrUrUrUrUrArGrAmGmCmUmAmGmAm AmAmUmAmGmCrArArGrUrUrArArArArUrArArGrGrCrUrArGrUrCrCrGrUrUrArUrCrAmAmCm UmUmGmAmAmAmAmAmGmUmGmGmCmAmCmCmGmAmGmUmCmGmGmUmGmCrGrCrUrGrCrCrArCrArAr UrArCrCrUrCrGrGrCrCrCrUrUrCrU*mC*mA*mG | 30540 |
| RNACS 4142 | hPKU 5_R12 P11 | mU*mA*mG*rCrGrArArCrUrGrArGrArArGrGrGrCrCrArGrUrUrUrUrArGrAmGmCmUmAmGmAm AmAmUmAmGmCrArArGrUrUrArArArArUrArArGrGrCrUrArGrUrCrCrGrUrUrArUrCrAmAmCm UmUmGmAmAmAmAmAmGmUmGmGmCmAmCmCmGmAmGmUmCmGmGmUmGmCrArCrArArUrArCrCrUrCr GrGrCrCrCrUrUrCrUrC*mA*mG*mU | 30541 |
| RNACS 4163 | hPKU 5_R16 P9 | mU*mA*mG*rCrGrArArCrUrGrArGrArArGrGrGrCrCrArGrUrUrUrUrArGrAmGmCmUmAmGmAm AmAmUmAmGmCrArArGrUrUrArArArArUrArArGrGrCrUrArGrUrCrCrGrUrUrArUrCrAmAmCm UmUmGmAmAmAmAmAmGmUmGmGmCmAmCmCmGmAmGmUmCmGmGmUmGmCrUrGrCrCrArCrArArUrAr CrCrUrCrGrGrCrCrCrUrUrC*mU*mC*mA | 30542 |

TABLE E5-continued

| Further Exemplary Template RNAs and Sequences for Mutation Correction | | | |
|---|---|---|---|
| RNACS# | Name | Sequence | SEQ ID NO |
| RNACS 4173 | hPKU 5_R18 P9 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrGrCrCrCrUrU*mC*mU*mC | 30543 |
| RNACS 4181 | hPKU 5_R20 P10 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrUrCrGrGrCrCrCrUrUrCrU*mC*mA*mG | 30544 |
| RNACS 4135 | hPKU 5_R10 P9 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrC*mU*mC*mA | 30545 |
| RNACS 1763 | hPKU 4_R18 P9 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrU*mC*mG*mC | 30546 |
| RNACS 3878 | hPKU 4_R16 P9 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrU*mC*mG*mC | 30547 |
| RNACS 3877 | hPKU 4_R16 P10 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrC*mG*mC*mU | 30548 |
| RNACS 3887 | hPKU 4_R18 P10 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrUrC*mG*mC*mU | 30549 |
| RNACS 3886 | hPKU 4_R18 P11 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrUrCrG*mC*mU*mA | 30550 |
| RNACS 3888 | hPKU 4_R18 P8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrU*mU*mC*mG | 30551 |
| RNACS 3897 | hPKU 4_R20 P9 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrGrCrCrCrUrUrCrUrCrArGrUrU*mC*mG*mC | 30552 |
| RNACS 3868 | hPKU 4_R14 P9 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrArCrCrUrCrGrGrCrCrCrUrUrCrUrCrArGrUrU*mC*mG*mC | 30553 |
| RNACS 3917 | hPKU 4_R24 P9 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrGrCrCrCrUrUrCrUrCrArGrUrU*mC*mG*mC | 30554 |
| RNACS 3907 | hPKU 4_R22 P9 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrGrCrCrCrUrUrCrUrCrArGrUrU*mC*mG*mC | 30555 |
| RNACS 4048 | hPKU 3_R17 P8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrU*mC*mG*mC | 30556 |
| RNACS 4057 | hPKU 3_R19 P8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrU*mC*mG*mC | 30557 |

TABLE E5-continued

Further Exemplary Template RNAs and Sequences for Mutation Correction

| RNACS# | Name | Sequence | SEQ ID NO |
|---|---|---|---|
| RNACS 4047 | hPKU 3_R17 P9 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrC*mG*mC*mU | 30558 |
| RNACS 4046 | hPKU 3_R17 P10 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrCrG*mC*mU*mA | 30559 |
| RNACS 1747 | hPKU 3_R19 P9 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrUrC*mG*mC*mU | 30560 |
| RNACS 4077 | hPKU 3_R23 P8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrGrCrCrCrUrUrCrUrCrArGrUrUmC*mG*mC | 30561 |
| RNACS 4056 | hPKU 3_R19 P10 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrUrCrG*mC*mU*mA | 30562 |
| RNACS 4044 | hPKU 3_R17 P12 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrCrGrCrU*mA*mC*mG | 30563 |
| RNACS 4045 | hPKU 3_R17 P11 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrCrGrC*mU*mA*mC | 30564 |
| RNACS 4055 | hPKU 3_R19 P11 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrUrCrGrC*mU*mA*mC | 30565 |
| RNACS 3640 | hPKU 6_R9P 12 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrGrGrCrCrGrArGrGrUrArUrUrGrUrGrGrC*mA*mG*mC | 30566 |
| RNACS 3641 | hPKU 6_R17 P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrUrGrArGrArArGrGrGrCrCrGrArGrGrUrArUrUrGrUrGrG*mC*mA*mG | 30567 |
| RNACS 3642 | hPKU 6_R13 P9 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArGrArArGrGrGrCrCrGrArGrGrUrArUrUrGrU*mG*mG*mC | 30568 |
| RNACS 3643 | hPKU 6_R11 P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrCrCrGrArGrGrUrArUrUrGrUrGrG*mC*mA*mG | 30569 |
| RNACS 3644 | hPKU 6_R15 P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrArGrArArGrGrGrCrCrGrArGrGrUrArUrUrGrUrGrG*mC*mA*mG | 30570 |
| RNACS 3645 | hPKU 6_R13 P10 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArGrArArGrGrGrCrCrGrArGrGrUrArUrUrGrUrG*mG*mC*mA | 30571 |

TABLE E5-continued

Further Exemplary Template RNAs and Sequences for Mutation Correction

| RNACS# | Name | Sequence | SEQ ID NO |
|---|---|---|---|
| RNACS 3646 | hPKU6_R11P13 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrCrCrGrArGrGrUrArUrUrGrUrGrGrCrA*mG*mC*mA | 30572 |
| RNACS 1792 | hPKU6_R9P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrGrGrCrCrGrArGrGrUrArUrUrGrUrGrG*mC*mA*mG | 30573 |
| RNACS 3647 | hPKU6_R13P13 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArGrArArGrGrGrCrCrGrArGrGrUrArUrUrGrUrGrGrCrA*mG*mC*mA | 30574 |
| RNACS 3648 | hPKU6_R11P9 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrCrCrGrArGrGrUrArUrUrGrU*mG*mG*mC | 30575 |

Table E5A shows the sequences of E5 without chemical modifications. In some embodiments, the sequences of Table E5 may be used without chemical modifications, or with one or more chemical modifications.

TABLE E5A

Table E5 Sequences without Chemical Modifications

| RNACS# | Name | Sequence | SEQ ID NO |
|---|---|---|---|
| RNACS 4947 | hPKU5_R12P10 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAG | 37227 |
| RNACS 2300 | hPKU5_R10P11 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGU | 37228 |
| RNACS 2301 | hPKU5_R12P12 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUU | 37229 |
| RNACS 4134 | hPKU5_R10P10 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAG | 37230 |
| RNACS 4172 | hPKU5_R18P10 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCGCUGCCACAAUACCUCGGCCCUUCUCAG | 37231 |
| RNACS 4142 | hPKU5_R12P11 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGU | 37232 |
| RNACS 4163 | hPKU5_R16P9 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCUGCCACAAUACCUCGGCCCUUCUCA | 37233 |
| RNACS 4173 | hPKU5_R18P8 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCGCUGCCACAAUACCUCGGCCCUUCUC | 37234 |
| RNACS 4181 | hPKU5_R20P10 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCUUGCUGCCACAAUACCUCGGCCCUUCUCAG | 37235 |
| RNACS 4135 | hPKU5_R10P9 | UAGCGAACUGAGAAGGGCCAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCA | 37236 |
| RNACS 1763 | hPKU4_R18P9 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGC | 37237 |
| RNACS 3878 | hPKU4_R16P9 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGC | 37238 |
| RNACS 3877 | hPKU4_R16P10 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGCU | 37239 |
| RNACS 3887 | hPKU4_R18P10 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGCU | 37240 |

TABLE E5A-continued

Table E5 Sequences without Chemical Modifications

| RNACS# | Name | Sequence | SEQ ID NO |
|---|---|---|---|
| RNACS 3886 | hPKU4_R18P11 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGCUA | 37241 |
| RNACS 3888 | hPKU4_R18P8 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCG | 37242 |
| RNACS 3897 | hPKU4_R20P9 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCCCACAAUACCUCGGCCCUUCUCAGUUCGC | 37243 |
| RNACS 3868 | hPKU4_R14P9 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCUACCUCGGCCCUUCUCAGUUCGC | 37244 |
| RNACS 3917 | hPKU4_R24P9 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCGCUGCCACAAUACCUCGGCCCUUCUCAGUUCGC | 37245 |
| RNACS 3907 | hPKU4_R22P9 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCUGCCACAAUACCUCGGCCCUUCUCAGUUCGC | 37246 |
| RNACS 4048 | hPKU3_R17P8 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGC | 37247 |
| RNACS 4057 | hPKU3_R19P8 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGC | 37248 |
| RNACS 4047 | hPKU3_R17P9 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGCU | 37249 |
| RNACS 4046 | hPKU3_R17P10 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGCUA | 37250 |
| RNACS 1747 | hPKU3_R19P9 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGCU | 37251 |
| RNACS 4077 | hPKU3_R23P8 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCUGCCACAAUACCUCGGCCCUUCUCAGUUCGC | 37252 |
| RNACS 4056 | hPKU3_R19P10 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGCUA | 37253 |
| RNACS 4044 | hPKU3_R17P12 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGCUACG | 37254 |
| RNACS 4045 | hPKU3_R17P11 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCAAUACCUCGGCCCUUCUCAGUUCGCUAC | 37255 |
| RNACS 4055 | hPKU3_R19P11 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGCUAC | 37256 |
| RNACS 3640 | hPKU6_R9P12 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGGCCGAGGUAUUGUGGCAGC | 37257 |
| RNACS 3641 | hPKU6_R17P11 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCACUGAGAAGGGCCGAGGUAUUGUGGCAG | 37258 |
| RNACS 3642 | hPKU6_R13P9 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAGAAGGGCCGAGGUAUUGUGGC | 37259 |
| RNACS 3643 | hPKU6_R11P11 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAAGGGCCGAGGUAUUGUGGCAG | 37260 |
| RNACS 3644 | hPKU6_R15P11 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCUGAGAAGGGCCGAGGUAUUGUGGCAG | 37261 |
| RNACS 3645 | hPKU6_R13P10 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAGAAGGGCCGAGGUAUUGUGGCA | 37262 |
| RNACS 3646 | hPKU6_R11P13 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAAGGGCCGAGGUAUUGUGGCAGCA | 37263 |
| RNACS 1792 | hPKU6_R9P11 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGGCCGAGGUAUUGUGGCAG | 37264 |
| RNACS 3647 | hPKU6_R13P13 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAGAAGGGCCGAGGUAUUGUGGCAGCA | 37265 |

TABLE E5A-continued

| Table E5 Sequences without Chemical Modifications | | | |
|---|---|---|---|
| RNACS# | Name | Sequence | SEQ ID NO |
| RNACS 3648 | hPKU6_ R11P9 | ACUUUGCUGCCACAAUACCUGUUUUAGAGCUAGAAAUAGCAAGUUAAAAUAAGGCUAGUCCGUUAUCAAC UUGAAAAAGUGGCACCGAGUCGGUGCAAGGGCCGAGGUAUUGUGGC | 37266 |

The gene modifying system comprising mRNA encoding the gene modifying polypeptide listed above, a template RNA listed above, and a second strand-targeting gRNA described above were transfected into primary human hepatocytes. The gene modifying polypeptide, template RNA, and second strand-targeting gRNA were delivered by nucleofection in the RNA format. Specifically, 4 μg of gene modifying polypeptide mRNA were combined with 10 μg of chemically synthesized template RNA in 5 μL of water. The transfection mix was added to 100,000 primary hepatocytes in Buffer P3 [Lonza], and cells were nucleofected using program DG-138. After nucleofection, cells were grown at 37° C., 5% $CO_2$ for 3 days prior to cell lysis and genomic DNA extraction. To analyze gene editing activity, primers flanking the target insertion site locus were used to amplify across the locus. Amplicons were analyzed via short read sequencing using an Illumina MiSeq. Conversion of C nucleotide to T nucleotide indicates successful editing.

Figure 25A:
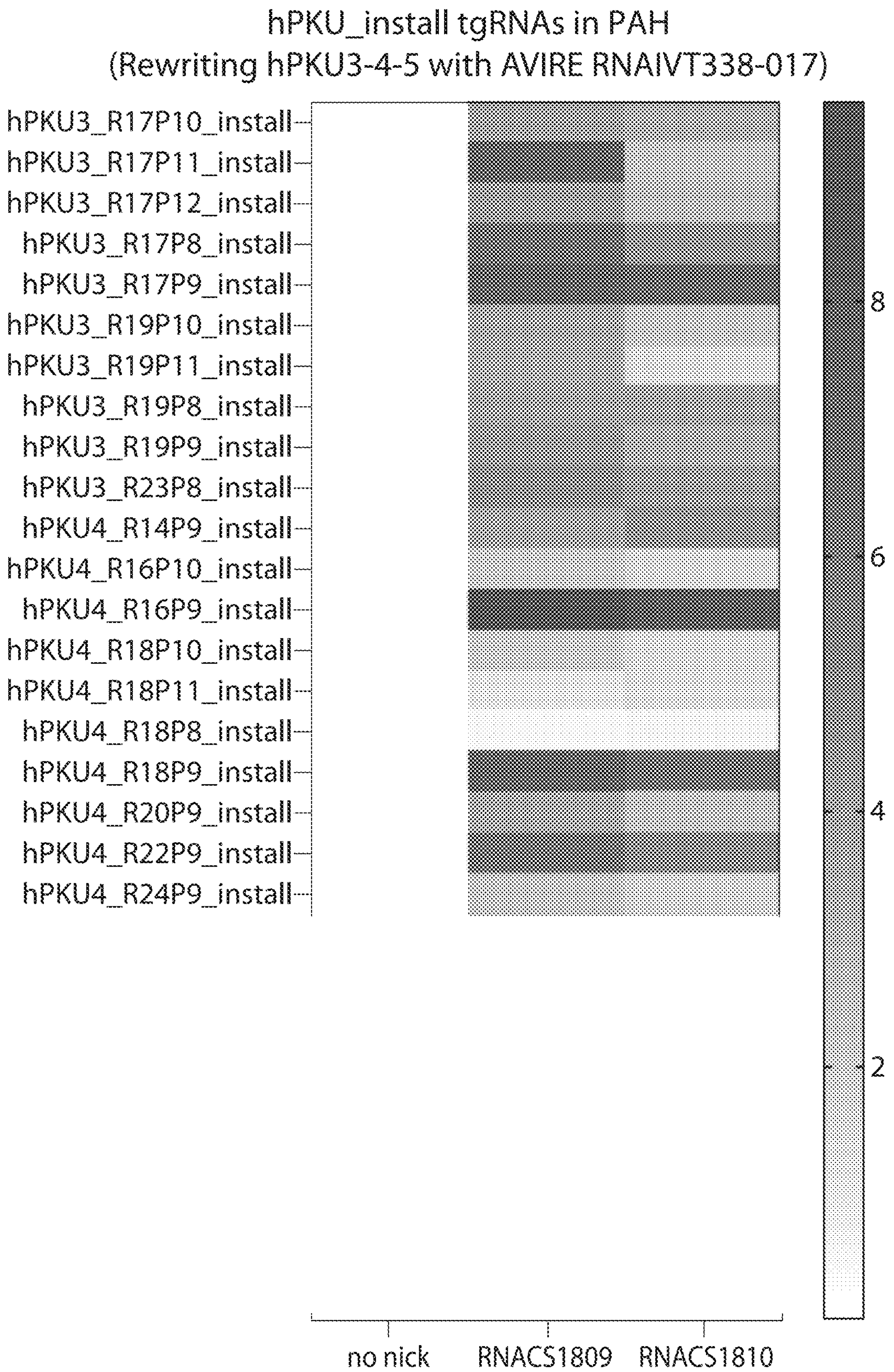
FIGS. 25A-25C are heat maps showing percent rewriting for each combination of template RNA and second strand-targeting RNA in primary human hepatocytes (FIG. 25A) and primary mouse hepatocytes (FIG. 25C) following transfection with (FIGS. 25A and 25B) or LNP delivery of (FIG. 25C) various gene modifying systems.

FIG. 25A shows a heatmap of % rewriting for each combination of template RNA and second strand-targeting RNA. The results show that many combinations of exemplary template RNAs and exemplary second strand-targeting gRNAs facilitated installation of the R408W mutation into hPAH gene of primary human hepatocytes.

The gene modifying system comprising mRNA encoding the gene modifying polypeptide listed above, a template RNA listed above, and a second strand-targeting gRNA described above were transfected into hepatoblasts differentiated from CRISPR-edited iPSCs containing the R408W mutation in the human PAH gene. Briefly PAH iPSCs are dissociated into single cells and then replated onto Geltex-coated plates. The iPSCs were then differentiated into definitive endoderm cells by treatment with Activin A, FGF2, and ChIR for 7 days. Definitive endoderm cells are then further patterned into foregut endoderm cells by activation of the BMP4 and FGF2 signaling pathway for an additional 6 days. Lastly, foregut endoderm cells were patterned into hepatoblast cells by treatment with oncostamin M, dexamethasone, hepatocyte growth factors, and ChIR for 12 days. Hepatoblasts were then sub-cultured onto collagen1-coated plates and expanded in media containing FGF19, Dexamethazone, ChIR, and SB431542 prior to transfection. The gene modifying polypeptide, template RNA, and second strand-targeting gRNA were delivered by nucleofection in the RNA format. Specifically, 4 μg of gene modifying polypeptide mRNA were combined with 10 μg of chemically synthesized template RNA, with or without 10 μg of second strand-targeting gRNA, in 5 μL of water. The transfection mix was added to 100,000 iPSCs in Buffer P3 [Lonza], and cells were nucleofected using program DG-138. After nucleofection, cells were grown at 37° C., 5% $CO_2$ for 3 days prior to cell lysis and genomic DNA extraction. To analyze gene editing activity, primers flanking the target insertion site locus were used to amplify across the locus. Amplicons were analyzed via short read sequencing using an Illumina MiSeq. Conversion of T>C indicates successful editing.

Figure 25B:
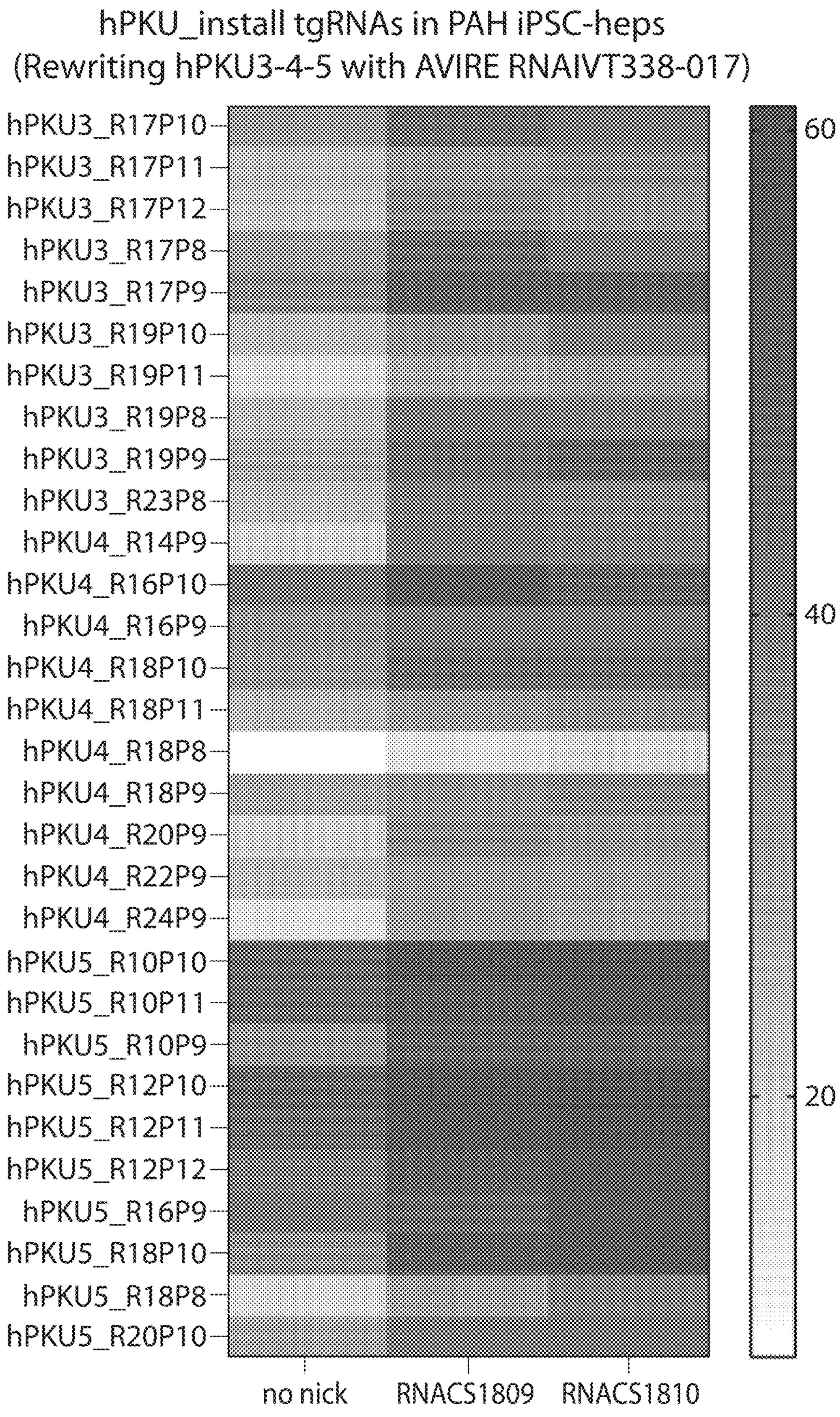

FIG. 25B shows a heatmap of % rewriting for each combination of template RNA and second strand-targeting RNA. The results show that many combinations of exemplary template RNAs and exemplary second strand-targeting gRNAs facilitated a corrective W408R mutation in the mutant hPAH gene of iPSC hepatoblasts. In particular, template RNAs RNACS1747, RNACS3877, RNACS4135, RNACS4134, RNACS2300, RNACS2299, RNACS4142, RNACS4173, RNACS4045, RNACS4048, and RNACS1763 showed the highest rewriting activity in this experiment.

The gene modifying system comprising mRNA encoding the gene modifying polypeptide listed above, a template RNA listed above, and a second strand-targeting gRNA described above were nucleofected in primary mouse hepatocytes from transgenic animals harboring the humanized region of exon 12 of the human PAH gene and contain the R408W PAH mutation. The gene modifying polypeptide, template RNA, and second strand-targeting gRNA were delivered by nucleofection in the RNA format. Specifically, 4 μg of gene modifying polypeptide mRNA were combined with 10 μg of chemically synthesized template RNA in 5 μL of water. The transfection mix was added to 100,000 primary hepatocytes in Buffer P3 [Lonza], and cells were nucleofected using program DG-138. After nucleofection, cells were grown at 37° C., 5% $CO_2$ for 3 days prior to cell lysis and genomic DNA extraction. To analyze gene editing activity, primers flanking the target insertion site locus were used to amplify across the locus. Amplicons were analyzed via short read sequencing using an Illumina MiSeq. Conversion of C nucleotide to T nucleotide indicates successful editing.

Figure 25C:
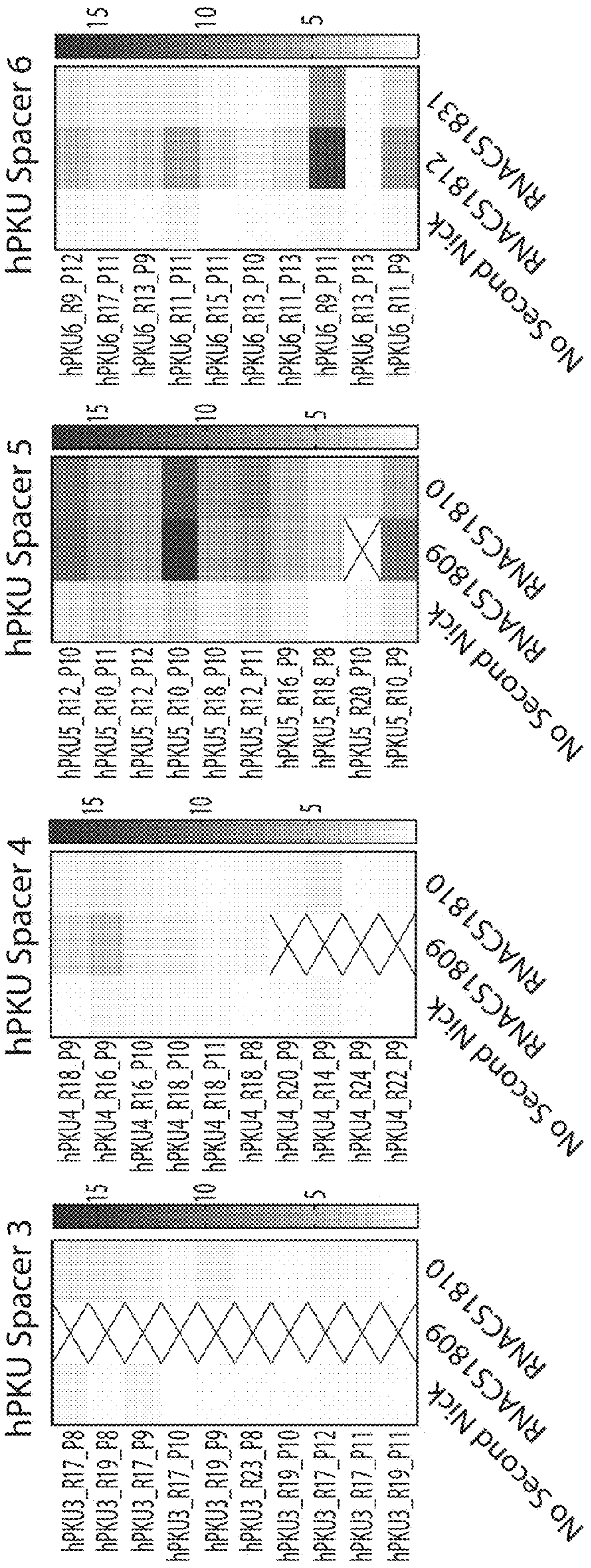

FIG. 25C shows a heatmap of % rewriting for each combination of template RNA and second strand-targeting RNA. The results show that many combinations of exemplary template RNAs and exemplary second strand-targeting gRNAs facilitated a corrective W408R mutation in the mutant hPAH gene of primary mouse hepatocytes. In particular, template RNAs RNACS4134 and RNACS1792 showed the highest rewriting activity in this experiment. In particular, template RNAs RNACS4134 and RNACS1792 showed high rewriting activity in combination with second strand-targeting gRNA RNACS1812 (about 17% and about 14% editing, respectively).

The gene modifying system comprising the gene modifying polypeptide listed above, a template RNA listed above, and a second strand-targeting gRNA listed above is formulated in LNP and delivered to mice. Specifically, approximately 2.4 mg/kg of total RNA equivalent formulated in LNPs (4:1 N:P ratio for mRNA, and 3:1 N:P ratio for tgRNA/gRNA), combined at 1:1:1 (w/w) of template RNA: mRNA:gRNA, are dosed intravenously in 8 to 10-week-old, mixed gender hPAH mice (0.8 mg/kg each of template RNA, mRNA, and gRNA) in a 10 ml/kg bolus. Mice are administered a dose at time 0 (t=0). 7 days post-dosing (as used herein post-dosing refers to time since the first dose), animals are sacrificed, and their liver and plasma are collected for analyses.

7-day plasma samples are analyzed by LC/MS to determine the level of phenylalanine present. Using CRISPR, hPAH transgenic mice were generated with a humanized region of exon 12 of the human PAH gene and contain the R408W PAH mutation that inactivates the PAH enzyme, resulting in sharply higher Phe levels in plasma than healthy wildtype mice. Successful rewriting of the hPAH transgene is expected to result in a decrease in Phe levels in plasma.]]

Phenylalanine is extracted from mouse plasma using protein precipitation and is analyzed by a LC-MS/MS system equipped with a Shimadzu Nexera UPLC (LC-40) coupled to a Sciex API 7500 mass spectrometer. Surrogate analyte (13C2,15N-Phenylalanine) is used for phenylalanine quantitation. Equivalence of ionization for naturally occurring and surrogate compounds is established prior to and after analytical run. Data are collected in the positive ion mode with three MRM transitions, 169.1 to 123.1 (13C2, 15N-Phenylalanine), 166.1 to 120.1 (Phenylalanine) and 172.1 to 126.0 (13C6-Phenylalanine, internal standard). Extracted samples are injected onto an Acquity UPLC BEH C18 column (1.7 μm, 2.1×50 mm) and eluted using a gradient of 0% to 15% of mobile phase B at a flow rate of 0.8 mL/min with a total run time of 3 min per injection. Mobile phase A is 100:2:0.1 H2O:Formic acid (FA): Trifluoroacetic acid (TFA) and mobile phase B is 95:5:2:0.1 ACN:H2O:FA:TFA. Data are processed using Sciex OS software.

The results will show that Phe levels decreased in plasma from mice with exemplary gene modifying systems targeting hPAH.

7-day liver samples are analyzed using Amp-Seq to determine % rewriting in target liver cells. To analyze gene editing activity, primers flanking the target insertion site locus are used to amplify across the locus in the genomic DNA of liver samples. Amplicons are analyzed via short read sequencing using an Illumina MiSeq. Conversion of a T nucleotide to a C nucleotide at position 1222 in the PAH gene indicates successful editing. The results will show that rewriting is observed in mice treated with exemplary gene modifying systems targeting hPAH.

Example 14: Evaluating the Rewriting Activity Over Time and Short-Term Safety of Exemplary Murine Template RNAs and Second Strand-Targeting gRNAs in an ENU2 Mouse Model This example describes the use of exemplary gene modifying systems containing a gene modifying polypeptide, an exemplary template RNA, and exemplary second strand-targeting gRNA to evaluate the stability of rewriting over time and the short term safety of gene modifying systems used to correct the F263S mutation in ENU2 mice.

In this example, a template RNA contained:

(1) a gRNA spacer;

(2) a gRNA scaffold;

(3) a heterologous object sequence; and (4) a primer binding site (PBS) sequence.

The exemplary template RNA tested was template RNA RNACS1855 shown in Table E1. The exemplary second strand-targeting gRNA was ngRNA5 (also referred to herein as RNACS2101), shown in Table E2. The exemplary gene modifying polypeptide used was RNAIVT338 (as described above and corresponding to the amino acid sequence of SEQ ID NO: 30480).

The gene modifying system was formulated in LNP and delivered to mice. [[Specifically, 2.4 mpk of total RNA equivalent formulated in LNPs, combined at 1:1 (w/w) of template RNA and mRNA, were dosed intravenously in 8 to 10-week-old, mixed gender ENU2 mice (0.8 mg/kg each of template RNA and mRNA with an additional 0.8 mg/kg of ngRNA in a 10 ml/kg bolus. Mice were administered a dose at time 0 (t=0). 7 days and 28 days post-dosing, animals were sacrificed, and their liver, brain, plasma collected for analyses.

Figure 26B:
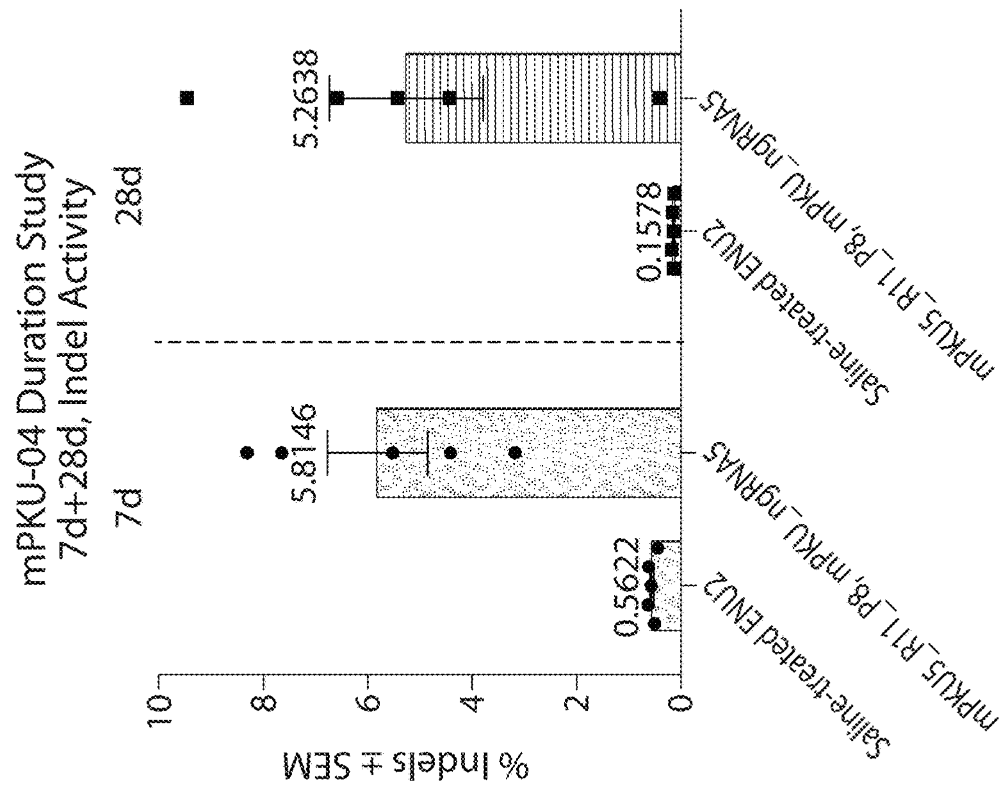
FIGS. 26A-26B are graphs showing percent rewriting (FIG. 26A) and percent indels (FIG. 26B) in 7- and 28-day liver samples following LNP delivery of gene modifying systems to mice.
Figure 26A:
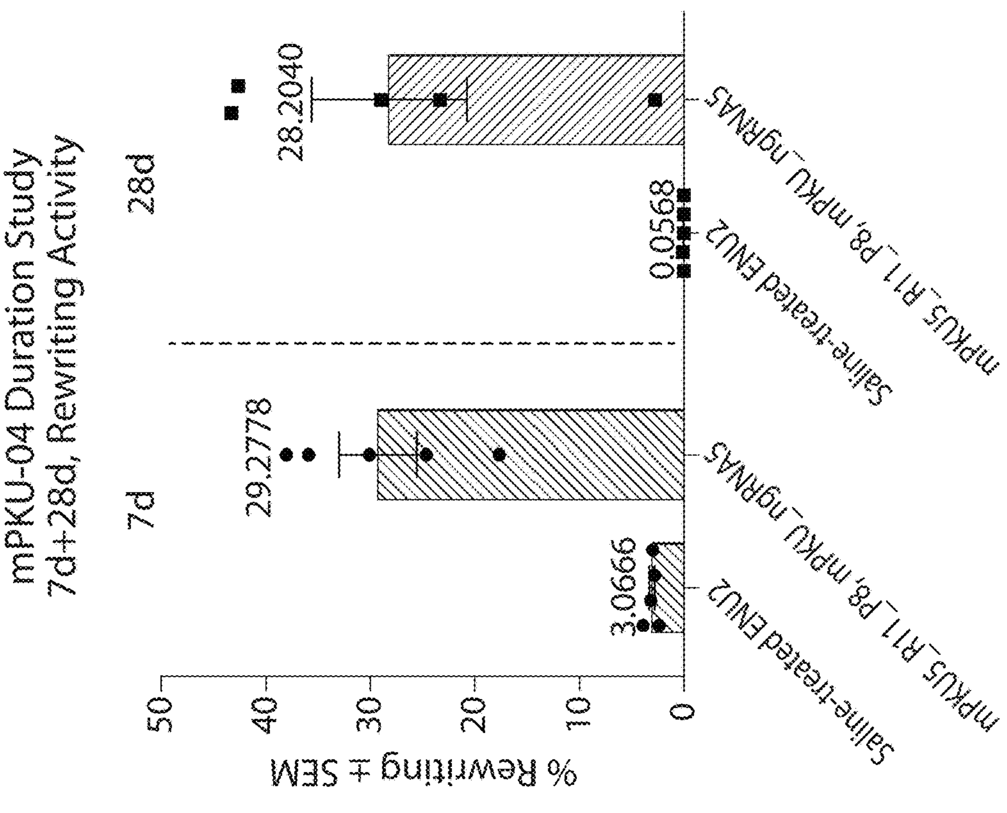

7-day and 28-day liver samples were analyzed using Amp-Seq to determine % rewriting in target liver cells (FIG. 26A). To analyze gene editing activity, primers flanking the target insertion site locus were used to amplify across the locus in the genomic DNA of liver samples. Amplicons were analyzed via short read sequencing using an Illumina MiSeq. Conversion of a C nucleotide to a T nucleotide at position 835 in the PAH gene indicated successful editing. Rewriting was observed from all treated mice at the 7 d and 28 d timepoints, and the % rewriting at the 7 d and 28 d timepoints were very similar. Amplicon sequencing was also used to evaluate the degree to which INDELs were introduced into the liver sample DNA (FIG. 26B). As seen in other data described herein, the % INDEL was significantly lower than the % rewriting, and the % INDEL at the 7 d and 28 d timepoints were very similar.

7-day and 28-day plasma and brain samples were also analyzed by LC/MS to determine the level of phenylalanine present. ENU2 mice harbor a mutation in the murine PAH gene that inactivates the PAH enzyme, resulting in sharply higher Phe levels in plasma and brain than healthy wildtype mice.

Phenylalanine was extracted from mouse plasma and brain using protein precipitation and then analyzed by a LC-MS/MS system equipped with a Shimadzu Nexera UPLC (LC-40) coupled to a Sciex API 7500 mass spectrometer. Surrogate analyte (13C2,15N-Phenylalanine) was used for phenylalanine quantitation. Equivalence of ionization for naturally occurring and surrogate compounds was established prior to and after analytical run. Data were collected in the positive ion mode with three MRM transitions, 169.1 to 123.1 (13C2,15N-Phenylalanine), 166.1 to 120.1 (Phenylalanine) and 172.1 to 126.0 (13C6-Phenylalanine, internal standard). Extracted samples were injected onto an Acquity UPLC BEH C18 column (1.7 μm, 2.1×50 mm) and eluted using a gradient of 0% to 15% of mobile phase B at a flow rate of 0.8 mL/min with a total run time of 3 min per injection. Mobile phase A is 100:2:0.1 H2O: Formic acid (FA): Trifluoroacetic acid (TFA) and mobile phase B is 95:5:2:0.1 ACN:H2O:FA:TFA. Data were processed using Sciex OS software.

Figure 27:
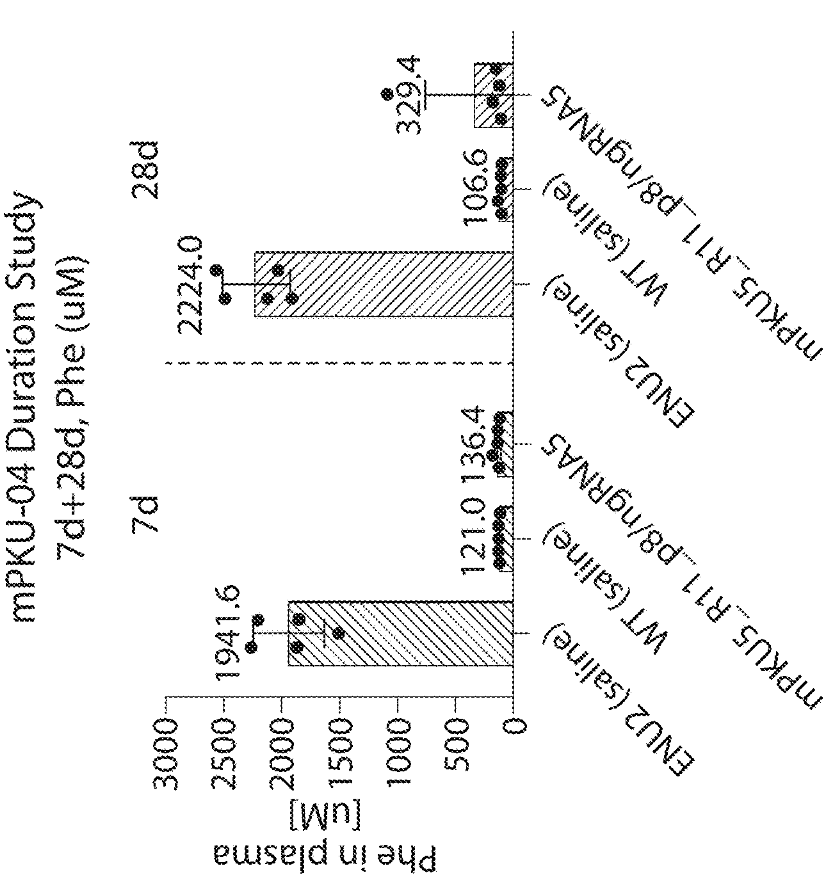
FIG. 27 is a graph showing the concentration of Phe in 7- and 28-day plasma samples following LNP delivery of gene modifying systems to mice.

The results showed that Phe levels decreased in plasma from all treated mice, consistent with correction of the PAH deactivating point mutation using the gene modifying polypeptide and template RNAs examined (FIG. 27). The plasma Phe levels were consistently low at the 7 d and 28*d* timepoints, showing that treated mice achieved stable Phe levels comparable to strain-matched wildtype mice at least out to 28*d*. When considered together (FIGS. 26A-27), the results show that the exemplary gene modifying systems can be used to specifically rewrite the mPAH gene of ENU2 mice, resulting in stable genetic modification and stable therapeutic phenotypic change.

Figure 28:
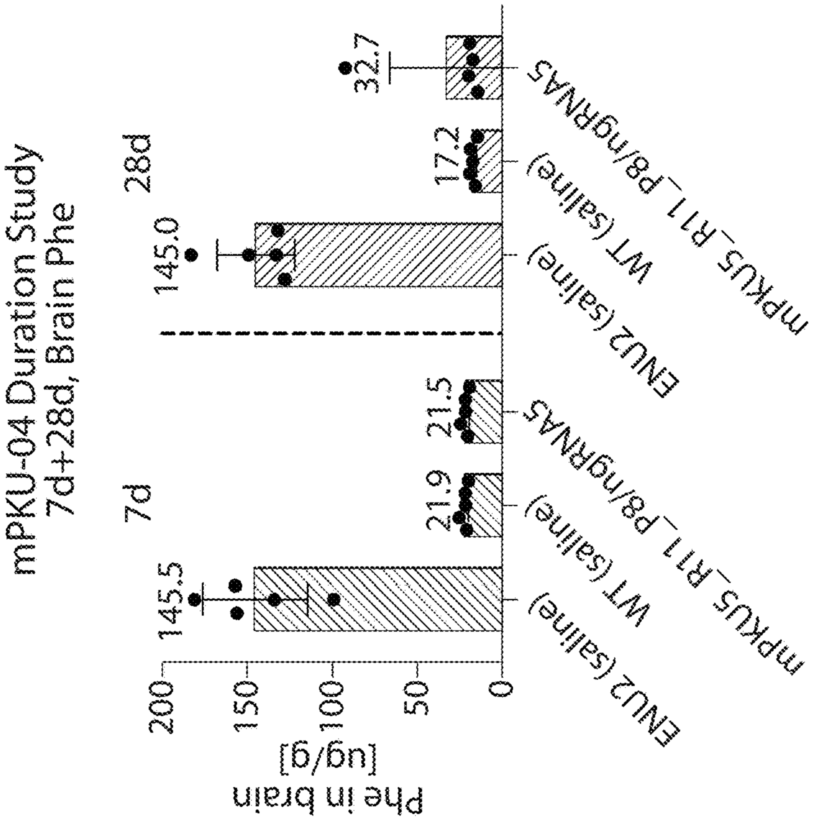
FIG. 28 is a graph showing the concentration of Phe in 7- and 28-day brain samples following LNP delivery of gene modifying systems to mice.

The results showed that Phe levels decreased in brain from all treated mice, consistent with correction of the PAH deactivating point mutation using the gene modifying polypeptide and template RNAs examined (FIG. 28). The brain Phe levels were consistently low at the 7 d and 28*d* timepoints, showing that treated mice achieved stable Phe levels comparable to strain-matched wildtype mice at least out to 28*d*. When considered together (FIGS. 26A-26B and 28), the results show that the exemplary gene modifying systems can be used to specifically rewrite the mPAH gene of ENU2 mice, resulting in stable genetic modification and stable therapeutic phenotypic change.

Figure 29:
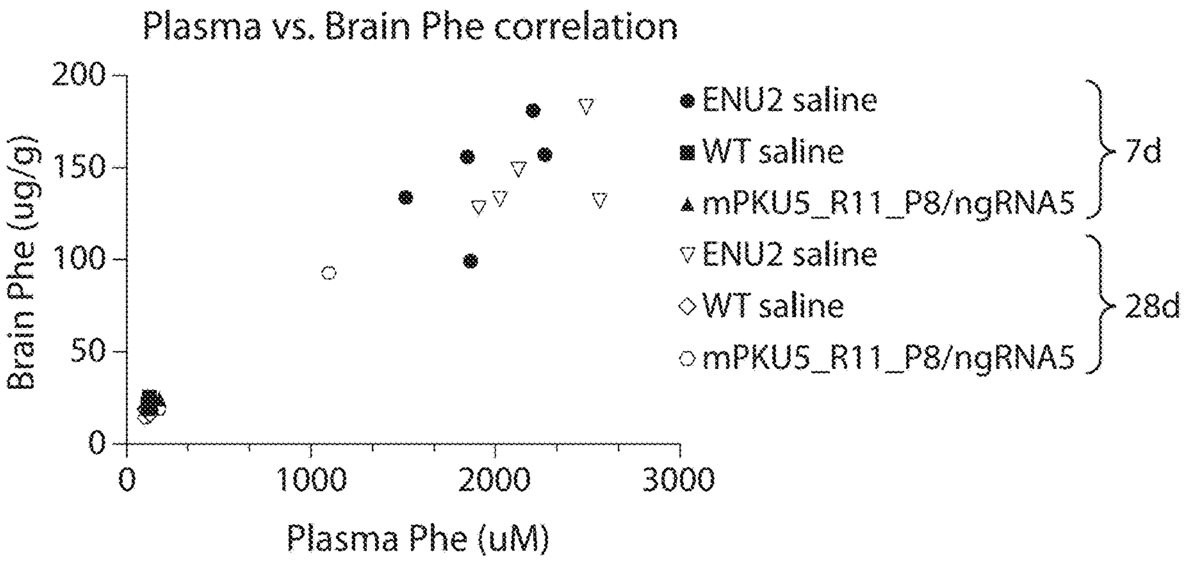
FIG. 29 is a graph showing the concentration of Phe in the brain versus concentration of Phe in the plasma from samples used to generate FIGS. 27 and 28.
Figure 30B:
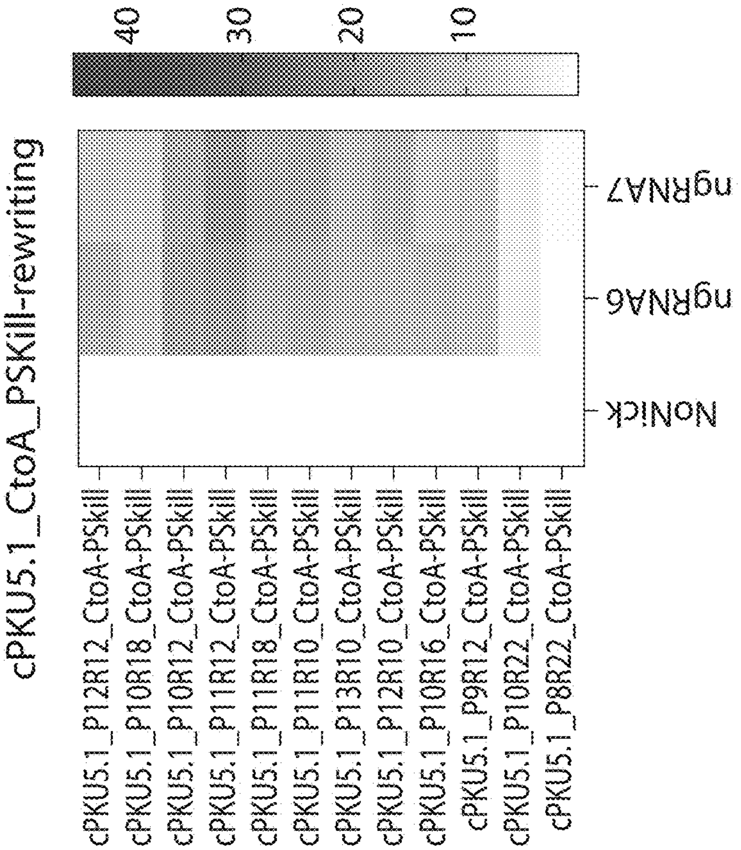
Figure 30A:
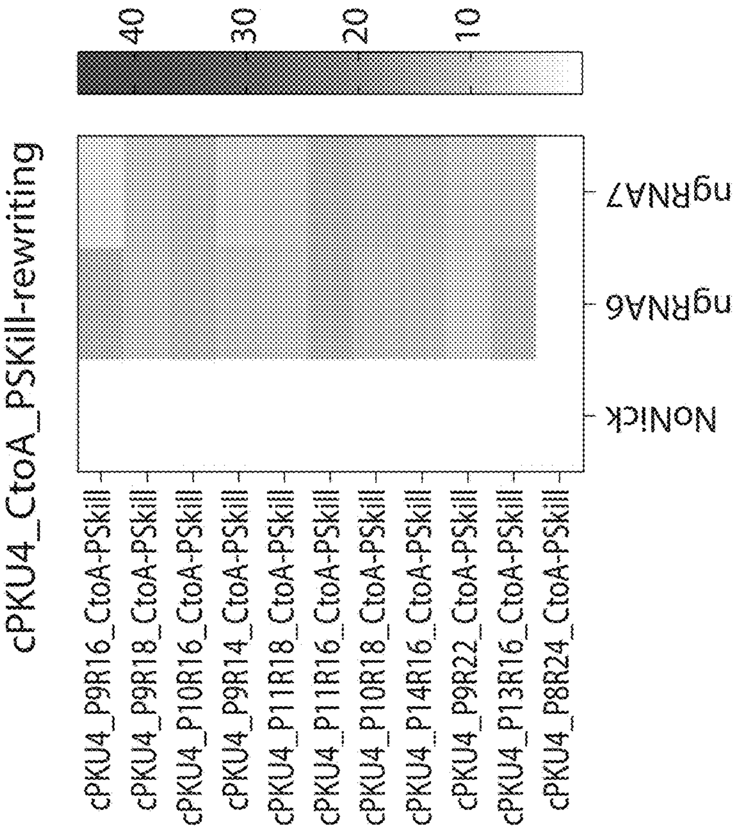
Figure 30C:
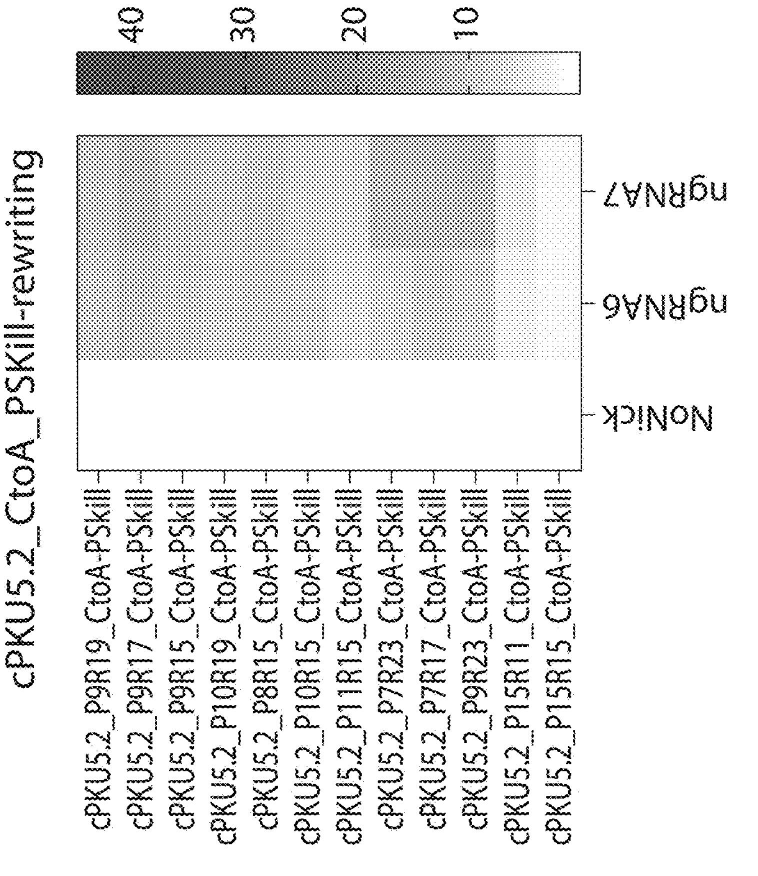
Figure 30D:
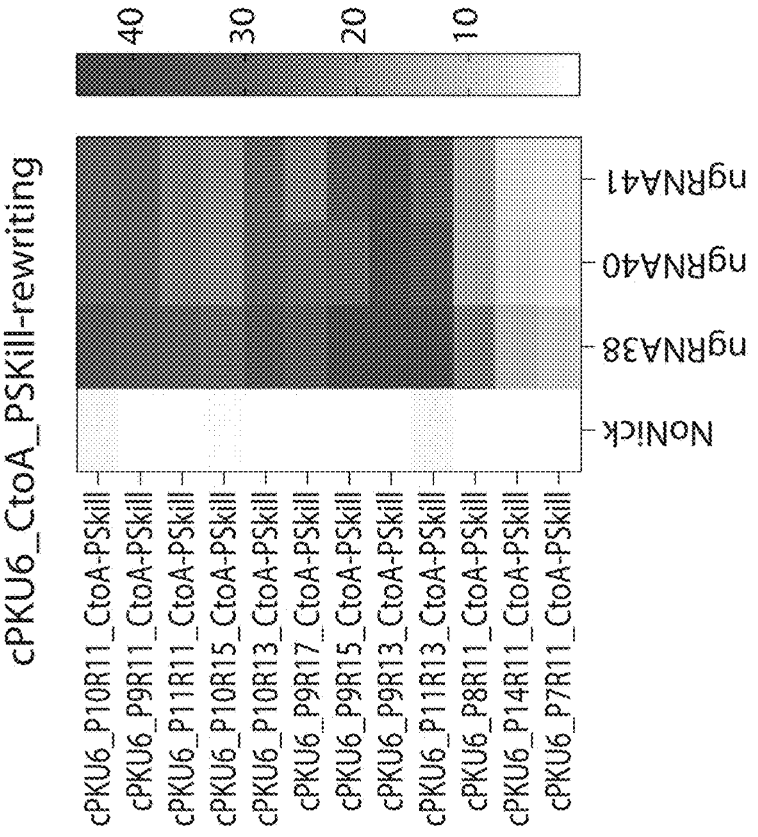
Figure 30F:
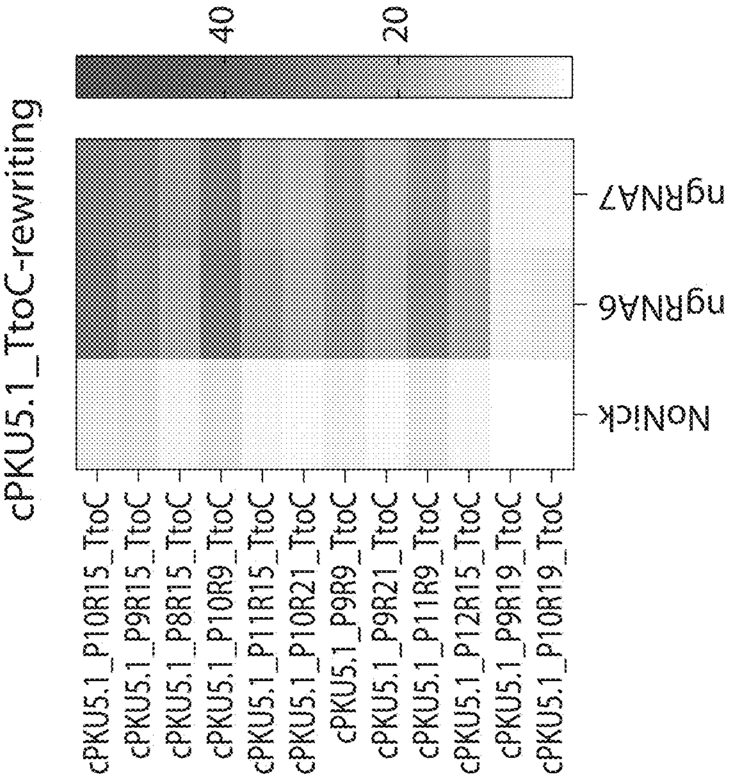
Figure 30E:
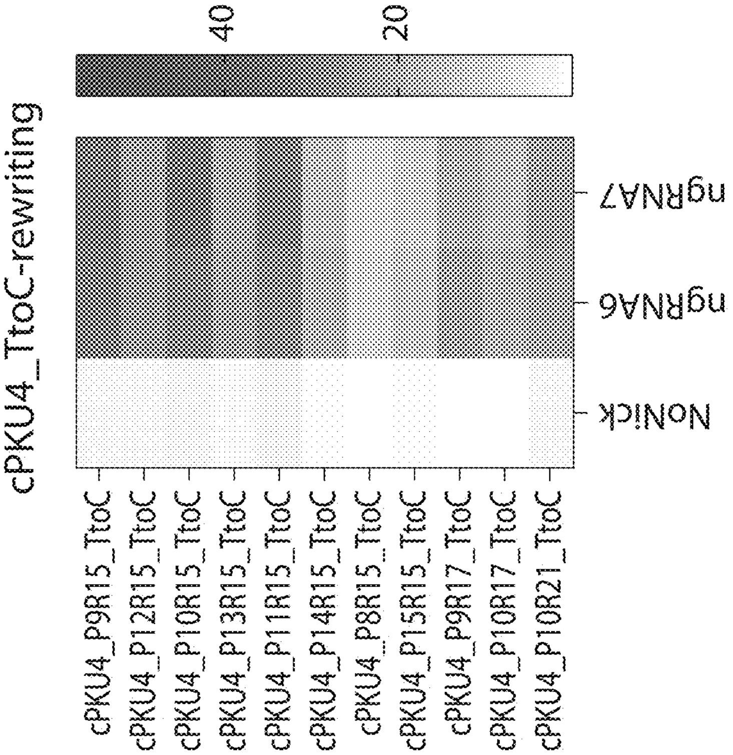
Figure 30H:
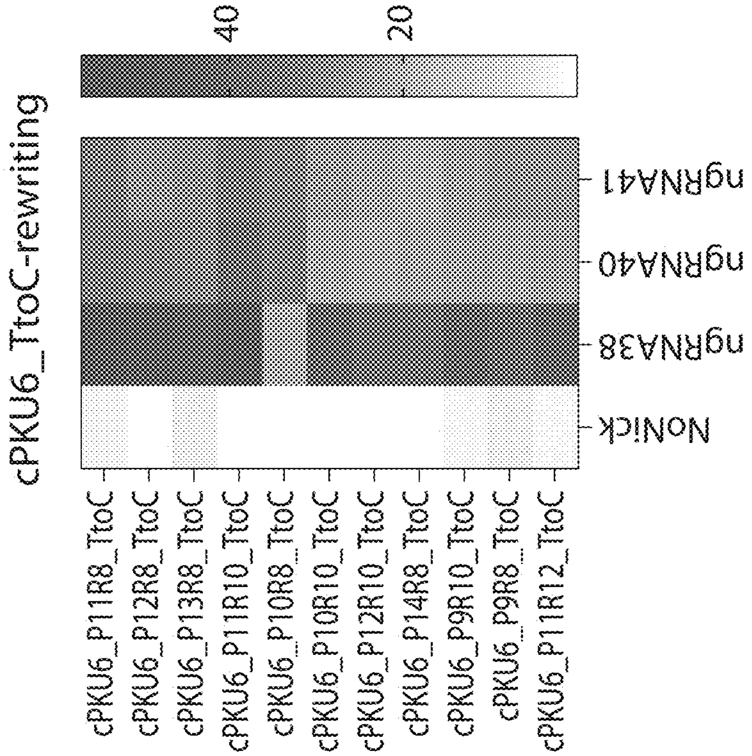
Figure 30G:
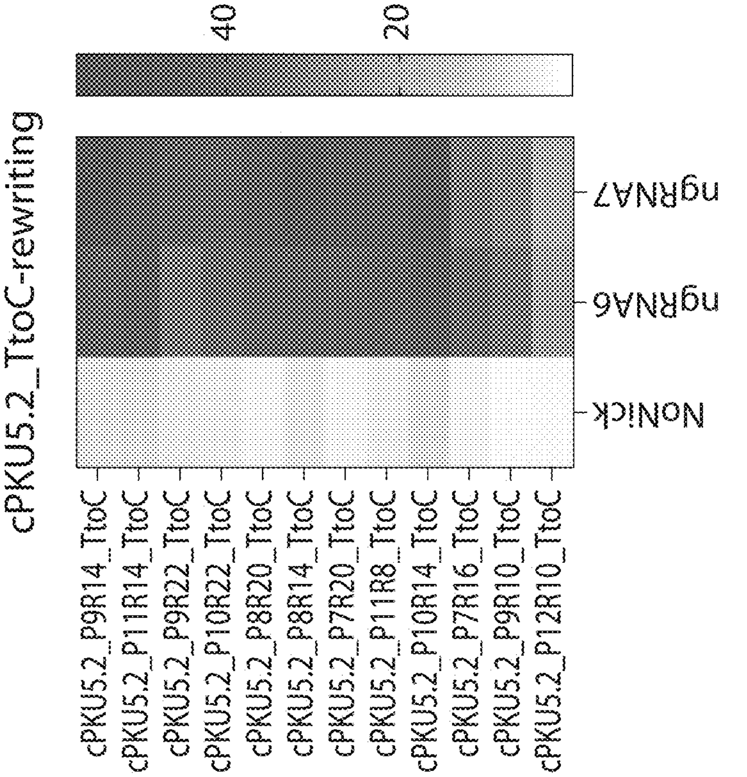

FIG. 29 shows a graph plotting correlation of plasma and brain Phe levels from samples used to generate FIGS. 27 and 28. The results show that plasma Phe level and brain Phe levels strongly correlate, with samples derived from saline treated ENU2 mice having higher Phe levels in plasma and in brain and samples derived from ENU2 mice treated with exemplary gene modifying systems as described herein having much lower Phe levels in plasma and in brain, similar to samples from saline treated wildtype mice.

At 90 days post dosing, animals are sacrificed, and their liver, brain, and plasma collected for analyses. The above analyses of % rewriting, % INDEL, and plasma Phe level are repeated with 90 d liver, brain, and plasma samples. The results will show comparable rewriting and INDEL levels to 7 d and 28 d samples from treated mice, and comparable Phe plasma and brain levels to 7 d and 28 d samples from treated mice.

Example 15: Evaluating Rewriting Activity of Exemplary Template RNAs and Second Strand-Targeting gRNAs in Cynomolgus Macaque Hepatocytes This example describes the use of exemplary gene modifying systems containing a gene modifying polypeptide, template RNAs comprising varied spacers, lengths and compositions of heterologous object sequences, and PBS sequences, and either of two second strand-targeting gRNAs to evaluate the activity of template RNAs and second strand-targeting gRNAs to produce a R408 silent mutation (C to A) or P407 silent mutation (T to C) mutation into wild-type PAH in primary cyno hepatocytes. Sequences (e.g., spacer sequences) of template RNAs or combinations of sequences of template RNAs and second strand-targeting gRNAs that provide high rewriting activity in a comparable model system may also provide rewriting activity in therapeutic template RNAs and second strand-targeting gRNAs designed for correcting pathogenic hPAH mutations in a human subject.

In this example, a template RNA contained:

(1) a gRNA spacer;

(2) a gRNA scaffold;

(3) a heterologous object sequence; and (4) a primer binding site (PBS) sequence.

Exemplary template RNAs generated and used are given in Table EX. Nucleotide modifications are noted as follows: phosphorothioate linkages denoted by an asterisk, 2'-O-methyl groups denoted by an 'm' preceding a nucleotide. The exemplary gene modifying polypeptide is RNAIVT338, comprising the amino acid sequence of SEQ ID NO: 30480. Exemplary second strand-targeting gRNAs for use with cPKU4, cPKU5.1, and cPKU5.2 template RNAs are RNACS1809 and RNACS1810, whereas exemplary second strand-targeting gRNAs for use with cPKU6 template RNAs are RNACS1906, RNACS1812, and RNACS1813, the nucleic acid sequence and chemical modifications of which are given here.

RNACS1809:

```
RNACS1809:
                                             (SEQ ID NO: 30576)
mG*mU*mG*rCrCrCrUrUrCrArCrUrCrArArGrCrCr
UrGrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCmU*mU
*mU*mU

RNACS1810:
                                             (SEQ ID NO: 30577)
mU*mU*mC*rArCrUrCrArArGrCrCrUrGrUrGrGrUr
UrUrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCmU*mU
*mU*mU

RNACS1812:
                                             (SEQ ID NO: 30578)
mG*mU*mC*rCrArArGrArCrCrUrCrArArUrCrCrUr
UrUrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCmU*mU
*mU*mU

RNACS1813:
                                             (SEQ ID NO: 30579)
mU*mG*mU*rCrCrArArGrArCrCrUrCrArArUrCrCr
UrUrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCmU*mU
*mU*mU

RNACS1906:
                                             (SEQ ID NO: 30580)
mC*mC*mU*rCrArArUrCrCrUrUrUrGrGrGrUrGrUr
ArUrGrUrUrUrUrArGrAmGmCmUmAmGmAmAmAmUmAm
GmCrArArGrUrUrArArArArUrArArGrGrCrUrArGr
UrCrCrGrUrUrArUrCrAmAmCmUmUmGmAmAmAmAmAm
GmUmGmGmCmAmCmCmGmAmGmUmCmGmGmUmGmCmU*mU
*mU*mU
```

TABLE EX

Further Exemplary Template RNAs and Sequences for use in *C. macaques*

| RNACS# | Name | Sequence | SEQ ID NO |
|---|---|---|---|
| RNACS 2611 | cPKU4_P9R16_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrArGrGrCrCrCrUrUrUrUrCrArGrUrU*mC*mG*mC | 30581 |
| RNACS 2620 | cPKU4_P9R18_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrArGrGrCrCrCrUrUrUrUrCrArGrUrU*mC*mG*mC | 30582 |
| RNACS 2610 | cPKU4_P10R16_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrArGrGrCrCrCrUrUrUrUrCrArGrUrUrC*mG*mC*mU | 30583 |
| RNACS 2602 | cPKU4_P9R14_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrCrCrCrUrArGrGrCrCrCrUrUrUrUrCrArGrUrU*mC*mG*mC | 30584 |
| RNACS 2618 | cPKU4_P11R18_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrArGrGrCrCrCrUrUrUrUrCrArGrUrUrCrG*mC*mU*mA | 30585 |
| RNACS 2609 | cPKU4_P11R16_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrArGrGrCrCrCrUrUrUrUrCrArGrUrUrCrG*mC*mU*mA | 30586 |
| RNACS 2619 | cPKU4_P10R18_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrArGrGrCrCrCrUrUrUrUrCrArGrUrUrC*mG*mC*mU | 30587 |
| RNACS 2606 | cPKU4_P14R16_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrArGrGrCrCrCrUrUrUrUrCrArGrUrUrCrGrCrUrA*mU*mG*mA | 30588 |
| RNACS 2638 | cPKU4_P9R22_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrCrCrCrUrArGrGrCrCrCrUrUrUrUrCrArGrUrU*mC*mG*mC | 30589 |
| RNACS 2607 | cPKU4_P13R16_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrArGrGrCrCrCrUrUrUrUrCrArGrUrUrCrGrCrU*mA*mU*mG | 30590 |
| RNACS 2648 | cPKU4_P8R24_CtoA-PSkill | mG*mG*mG*rUrCrArUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrUrArGrGrCrCrCrUrUrUrUrCrArGrU*mU*mC*mG | 30591 |

TABLE EX-continued

Further Exemplary Template RNAs and Sequences for use in *C. macaques*

| RNACS# | Name | Sequence | SEQ ID NO |
|---|---|---|---|
| RNACS 2689 | cPKU5.1_P12R12_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrArGrArCrCrCrUrUrCrUrCrA*mG*mU*mU | 30592 |
| RNACS 2718 | cPKU5.1_P10R18_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrUrArGrArCrCrCrUrUrCrU*mC*mA*mG | 30593 |
| RNACS 2691 | cPKU5.1_P10R12_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrArGrArCrCrCrUrUrCrU*mC*mA*mG | 30594 |
| RNACS 2690 | cPKU5.1_P11R12_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrArGrArCrCrCrUrUrCrUrC*mA*mG*mU | 30595 |
| RNACS 2717 | cPKU5.1_P11R18_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrUrArGrArCrCrCrUrUrCrUrC*mA*mG*mU | 30596 |
| RNACS 2681 | cPKU5.1_P11R10_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrArGrArCrCrCrUrUrCrUrC*mA*mG*mU | 30597 |
| RNACS 2679 | cPKU5.1_P13R10_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrArGrArCrCrCrUrUrCrUrCrArG*mU*mU*mC | 30598 |
| RNACS 2680 | cPKU5.1_P12R10_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrArGrArCrCrCrUrUrCrUrCrA*mG*mU*mU | 30599 |
| RNACS 2709 | cPKU5.1_P10R16_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrCrCrCrUrArGrArCrCrCrUrUrCrU*mC*mA*mG | 30600 |
| RNACS 2692 | cPKU5.1_P9R1-PSkill2_CtoA | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrArGrArCrCrCrUrUrC*mU*mC*mA | 30601 |
| RNACS 2736 | cPKU5.1_P10R22_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrUrGrCrUrGrCrCrArCrArArUrCrCrCrUrArGrArCrCrCrUrUrCrU*mC*mA*mG | 30602 |

TABLE EX-continued

Further Exemplary Template RNAs and Sequences for use in *C. macaques*

| RNACS# | Name | Sequence | SEQ ID NO |
|---|---|---|---|
| RNACS 2738 | cPKU5.1_P8R22_CtoA-PSkill | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrUrUrGrCrUrGrCrCrArCrArArUrCrCrCrUrArGrArCrCrCrUrU*mC*mU*mC | 30603 |
| RNACS 2782 | cPKU5.2_P9R19_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrUrArGrGrCrCrCrUrU*mC*mU*mC | 30604 |
| RNACS 2773 | cPKU5.2_P9R17_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrArGrGrCrCrCrUrU*mC*mU*mC | 30605 |
| RNACS 2764 | cPKU5.2_P9R15_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrArGrGrCrCrCrUrU*mC*mU*mC | 30606 |
| RNACS 2781 | cPKU5.2_P10R19_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrUrArGrGrCrCrCrUrUrC*mU*mC*mA | 30607 |
| RNACS 2765 | cPKU5.2_P8R15_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrArGrGrCrCrCrU*mU*mC*mU | 30608 |
| RNACS 2763 | cPKU5.2_P10R15_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrArGrGrCrCrCrUrUrC*mU*mC*mA | 30609 |
| RNACS 2762 | cPKU5.2_P11R15_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrArGrGrCrCrCrUrUrCrU*mC*mA*mG | 30610 |
| RNACS 2802 | cPKU5.2_P7R23_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrUrUrGrCrUrGrCrCrArCrArArUrArCrCrUrArGrGrCrCrC*mU*mU*mC | 30611 |
| RNACS 2775 | cPKU5.2_P7R17_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrArGrGrCrCrC*mU*mU*mC | 30612 |
| RNACS 2800 | cPKU5.2_P9R23_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrUrUrGrCrUrGrCrCrArCrArArUrArCrCrUrArGrGrCrCrCrUrU*mC*mU*mC | 30613 |
| RNACS 2740 | cPKU5.2_P15R11_Cto | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGm | 30614 |

TABLE EX-continued

Further Exemplary Template RNAs and Sequences for use in *C. macaques*

| RNACS# | Name | Sequence | SEQ ID NO |
|---|---|---|---|
| | A-PSkill | AmAmAmAmAmGmUmGmGmCmAmCmCmGmAmGmUmCmGmGmUmGmCrArCrArArUrArCrCrUrArGrGrCrCrCrUrUrCrUrCrArGrU*mU*mC*mG | |
| RNACS 2758 | cPKU5.2_P15R15_CtoA-PSkill | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrArGrGrCrCrCrUrUrCrUrCrArGrU*mU*mC*mG | 30615 |
| AC 2817 | _P10R11_CtoA cPKU6-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrUrCrUrArGrGrGrArUrUrGrUrG*mG*mC*mA | 30616 |
| RNACS 2818 | cPKU6_P9R11_CtoA-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrUrCrUrArGrGrGrArUrUrGrU*mG*mG*mC | 30617 |
| RNACS 2816 | cPKU6_P11R11_CtoA-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrUrCrUrArGrGrGrArUrUrGrUrGrG*mC*mA*mG | 30618 |
| RNACS 2835 | cPKU6_P10R15_CtoA-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrArGrArArGrGrGrUrCrUrArGrGrGrArUrUrGrUrG*mG*mC*mA | 30619 |
| RNACS 2826 | cPKU6_P10R13_CtoA-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArGrArArGrGrGrUrCrUrArGrGrGrArUrUrGrUrG*mG*mC*mA | 30620 |
| RNACS 2845 | cPKU6_P9R17_CtoA-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrUrGrArGrArArGrGrGrUrCrUrArGrGrGrArUrUrGrU*mG*mG*mC | 30621 |
| RNACS 2836 | cPKU6_P9R15_CtoA-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrArGrArArGrGrGrUrCrUrArGrGrGrArUrUrGrU*mG*mG*mC | 30622 |
| RNACS 2827 | cPKU6_P9R13_CtoA-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArGrArArGrGrGrUrCrUrArGrGrGrArUrUrGrU*mG*mG*mC | 30623 |
| RNACS 2825 | _P11R13_CtoA cPKU6-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArGrArArGrGrGrUrCrUrArGrGrGrArUrUrGrUrGrG*mC*mA*mG | 30624 |
| RNACS 2819 | cPKU6_P8R11_CtoA-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrUrCrUrArGrGrGrArUrUrG*mU*mG*mG | 30625 |
| RNACS 2813 | cPKU6_P14R11_CtoA-PSkill | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArGrGrGrUrCrUrArGrGrGrArUrUrGrUrGrGrCrArG*mC*mA*mA | 30626 |

TABLE EX-continued

Further Exemplary Template RNAs and Sequences for use in *C. macaques*

| RNACS# | Name | Sequence | SEQ ID NO |
|---|---|---|---|
| RNACS 2820 | cPKU6 _P7R11_ CtoA- PSkill | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArAr GrGrGrUrCrUrArGrGrGrArUrU*mG*mU*mG | 30627 |
| RNACS 3178 | cPKU4 _P9R15_ TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArUr CrCrCrCrCrGrGrCrCrCrUrUrCrUrCrArGrUrU*mC*mG*mC | 30628 |
| RNACS 3175 | cPKU4 _P12R1 5_TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArUr CrCrCrCrCrGrGrCrCrCrUrUrCrUrCrArGrUrUrCrGrC*mU*mA* mU | 30629 |
| RNACS 3177 | cPKU4 _P10R1 5_TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArUr CrCrCrCrCrGrGrCrCrCrUrUrCrUrCrArGrUrUrC*mG*mC*mU | 30630 |
| RNACS 3174 | cPKU4 _P13R1 5_TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArUr CrCrCrCrCrGrGrCrCrCrUrUrCrUrCrArGrUrUrCrGrCrU*mA*m U*mG | 30631 |
| RNACS 3176 | cPKU4 _P11R1 5_TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArUr CrCrCrCrCrGrGrCrCrCrUrUrCrUrCrArGrUrUrCrG*mC*mU*mA | 30632 |
| RNACS 3173 | cPKU4 _P14R1 5_TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArUr CrCrCrCrCrGrGrCrCrCrUrUrCrUrCrArGrUrUrCrGrCrUrA*mU *mG*mA | 30633 |
| RNACS 3179 | cPKU4 _P8R15_ TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArUr CrCrCrCrCrGrGrCrCrCrUrUrCrUrCrArGrU*mU*mC*mG | 30634 |
| RNACS 3172 | cPKU4 _P15R1 5_TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArUr CrCrCrCrCrGrGrCrCrCrUrUrCrUrCrArGrUrUrCrGrCrUrArU* mG*mA*mC | 30635 |
| RNACS 3187 | cPKU4 _P9R17_ TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrCrAr ArUrCrCrCrCrCrGrGrCrCrCrUrUrCrUrCrArGrUrU*mC*mG*mC | 30636 |
| RNACS 3186 | cPKU4 _P10R1 7_TtoC | mG*mG*mG*rUrCrArUrArGrCrGrArArCrUrGrArGrArArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrCrAr ArUrCrCrCrCrCrGrGrCrCrCrUrUrCrUrCrArGrUrUrC*mG*mC* mU | 30637 |
| RNACS 3204 | cPKU4 _P10R2 | mG*mG*mG*rUrCrArUrArGrCrGrArArCrUrGrArGrArArGrUrUr UrUrArGrAmGmCmUmAmGmAmAmAmUmAmGmCrArArGrUrUrArArAr | 30638 |

TABLE EX-continued

Further Exemplary Template RNAs and Sequences for use in *C. macaques*

| RNACS# | Name | Sequence | SEQ ID NO |
|---|---|---|---|
| | 1_TtoC | ArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArCrArArUrCrCrCrCrCrGrGrCrCrCrUrUrCrUrCrArGrUrUrC*mG*mC*mU | |
| RNACS 3276 | cPKU5.1_P10R15_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArArUrCrCrCrCrCrGrGrCrCrCrUrUrCrU*mC*mA*mG | 30639 |
| RNACS 3277 | cPKU5.1_P9R15_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArArUrCrCrCrCrCrGrGrCrCrCrUrUrC*mU*mC*mA | 30640 |
| RNACS 3278 | cPKU5.1_P8R15_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArCrArArUrCrCrCrCrCrGrGrCrCrCrUrU*mC*mU*mC | 30641 |
| RNACS 3249 | cPKU5.1_P10R9_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArUrCrCrCrCrCrGrGrCrCrCrUrUrCrU*mC*mA*mG | 30642 |
| RNACS 3275 | cPKU5.1_P11R15_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArCrArArUrCrCrCrCrCrGrGrCrCrCrUrUrCrUrC*mA*mG*mU | 30643 |
| RNACS 3303 | cPKU5.1_P10R21_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrUrGrCrUrGrCrCrArCrArArUrCrCrCrCrCrGrGrCrCrCrUrUrCrU*mC*mA*mG | 30644 |
| RNACS 3250 | cPKU5.1_P9R9_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArUrCrCrCrCrCrGrGrCrCrCrUrUrC*mU*mC*mA | 30645 |
| RNACS 3304 | cPKU5.1_P9R21_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrUrGrCrUrGrCrCrArCrArArUrCrCrCrCrCrGrGrCrCrCrUrUrC*mU*mC*mA | 30646 |
| RNACS 3248 | cPKU5.1_P11R9_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArUrCrCrCrCrCrGrGrCrCrCrUrUrCrUrC*mA*mG*mU | 30647 |
| RNACS 3274 | 1_P12R15_TtoC cPKU5. | mAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArCrArArUrCrCrCrCrCrGrGrCrCrCrUrUrCrUrCrA*mG*mU*mUmU*mA*mG*rCrGrArArCrUrGrArGrArArGrGrGrCrCrGrGrUrUrUrUrArGrAmGmCmUmAmGmAmA | 30648 |
| RNACS 3295 | cPKU5.1_P9R19_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrUrGrCrCrArCrArArUrCrCrCrCrCrGrGrCrCrCrUrUrC*mU*mC*mA | 30649 |

TABLE EX-continued

Further Exemplary Template RNAs and Sequences for use in *C. macaques*

| RNACS# | Name | Sequence | SEQ ID NO |
|---|---|---|---|
| RNACS3294 | cPKU5.1_P10R19_TtoC | mU*mA*mG*rCrGrArArCrUrGrArGrArArGrGrGrCrCrGrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrUrGrCrCrArCrArArUrCrCrCrCrCrGrGrCrCrCrUrUrCrU*mC*mA*mG | 30650 |
| RNACS3349 | cPKU5.2_P9R14_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArCrArArUrCrCrCrCrCrGrGrCrCrCrUrU*mC*mU*mC | 30651 |
| RNACS3347 | cPKU5.2_P11R14_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArCrArArUrCrCrCrCrCrGrGrCrCrCrUrUrCrU*mC*mA*mG | 30652 |
| RNACS3385 | cPKU5.2_P9R22_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrUrUrUrGrCrUrGrCrCrArCrArArUrCrCrCrCrCrGrGrCrCrCrUrU*mC*mU*mC | 30653 |
| RNACS3384 | cPKU5.2_P10R22_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrUrUrUrGrCrUrGrCrCrArCrArArUrCrCrCrCrCrGrGrCrCrCrUrUrC*mU*mC*mA | 30654 |
| RNACS3377 | cPKU5.2_P8R20_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrUrGrCrUrGrCrCrArCrArArUrCrCrCrCrCrGrGrCrCrCrU*mU*mC*mU | 30655 |
| RNACS3350 | cPKU5.2_P8R14_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArCrArArUrCrCrCrCrCrGrGrCrCrCrU*mU*mC*mU | 30656 |
| RNACS3378 | cPKU5.2_P7R20_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrUrGrCrUrGrCrCrArCrArArUrCrCrCrCrCrGrGrCrCrC*mU*mU*mC | 30657 |
| RNACS3320 | cPKU5.2_P11R8_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArUrCrCrCrCrCrGrGrCrCrCrUrUrCrU*mC*mA*mG | 30658 |
| RNACS3348 | cPKU5.2_P10R14_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrCrArCrArArUrCrCrCrCrCrGrGrCrCrCrUrUrC*mU*mC*mA | 30659 |
| RNACS3360 | cPKU5.2_P7R16_TtoC | mA*mG*mC*rGrArArCrUrGrArGrArArGrGrGrCrCrGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrCrCrArCrArArUrCrCrCrCrCrGrGrCrCrC*mU*mU*mC | 30660 |
| RNACS3331 | cPKU5.2_P9R1 | mA*mG*mC*rGrArArCrUrGrArGrArArGrGrGrCrCrGrArGrUrUrUrUrArGrAmGmCmUmAmGmAmAmAmUmAmGmCrArArGrUrUrArArAr | 30661 |

TABLE EX-continued

| RNACS# | Name | Sequence | SEQ ID NO |
|---|---|---|---|
| Further Exemplary Template RNAs and Sequences for use in *C. macaques* | | | |
| | 0_TtoC | ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrCrAr ArUrCrCrCrCrCrGrGrCrCrCrUrU*mC*mU*mC | |
| RNACS 3328 | cPKU5. 2_P12R 10_Tto C | mA*mG*mC*rGrArArCrUrGrArGrArArGrGrGrCrCrGrArGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrCrAr ArUrCrCrCrCrCrGrGrCrCrCrUrUrCrUrC*mA*mG*mU | 30662 |
| RNACS 3392 | cPKU6 _P11R8_ TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrGrGr CrCrGrGrGrGrGrArUrUrGrUrGrG*mC*mA*mG | 30663 |
| RNACS 3391 | cPKU6 _P12R8_ TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrGrGr CrCrGrGrGrGrGrArUrUrGrUrGrUrGrGrC*mA*mG*mC | 30664 |
| RNACS 3390 | cPKU6_ P13R8_ TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrGrGr CrCrGrGrGrGrGrArUrUrGrUrGrGrCrA*mG*mC*mA | 30665 |
| RNACS 3401 | cPKU6 _P11R1 0_TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArGr GrGrCrCrGrGrGrGrGrArUrUrGrUrGrG*mC*mA*mG | 30666 |
| RNACS 3393 | cPKU6 _P10R8_ TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrGrGr CrCrGrGrGrGrGrArUrUrGrUrG*mG*mC*mA | 30667 |
| RNACS 3402 | cPKU6 _P10R1 0_TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArGr GrGrCrCrGrGrGrGrGrArUrUrGrUrG*mG*mC*mA | 30668 |
| RNACS 3400 | cPKU6 _P12R1 0_TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArGr GrGrCrCrGrGrGrGrGrArUrUrGrUrGrGrC*mA*mG*mC | 30669 |
| RNACS 3389 | cPKU6 _P14R8_ TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrGrGr CrCrGrGrGrGrGrArUrUrGrUrGrGrCrArG*mC*mA*mA | 30670 |
| RNACS 3403 | cPKU6 _P9R10 _TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrArGr GrGrCrCrGrGrGrGrGrArUrUrGrU*mG*mG*mC | 30671 |
| RNACS 3394 | cPKU6 _P9R8 _TtoC | mA*mC*mU*rUrUrGrCrUrGrCrCrArCrArArUrCrCrCrUrGrUrUr UrUrArGrAmGmCmUmAmGmAmAmAmUmAmGmCrArArGrUrUrArArAr ArUrArArGrGrCrUrArGrUrCrCrGrUrUrArUrCrAmAmCmUmUmGm AmAmAmAmAmGmUmGmGmCmAmCmCmGmAmGmUmCmGmGmUmGmCrGrGr CrCrGrGrGrGrGrArUrUrGrU*mG*mG*mC | 30672 |

TABLE EX-continued

Further Exemplary Template RNAs and Sequences for use in *C. macaques*

| RNACS# | Name | Sequence | SEQ ID NO |
|---|---|---|---|
| RNACS 3410 | cPKU6 _P11R1 2_TtoC | mA*mC*mU*rUrUrGrCrUrGrCrCrArCrArArUrCrCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArArGrGrGrCrCrGrGrGrGrGrArUrUrGrUrGrG*mC*mA*mG | 30673 |

The gene modifying system comprising mRNA encoding the gene modifying polypeptide listed above, a template RNA listed above, and a second strand-targeting gRNA described above were transfected into primary cyno hepatocytes. The gene modifying polypeptide, template RNA, and second strand-targeting gRNA were delivered by nucleofection in the RNA format. Specifically, 4 μg of gene modifying polypeptide mRNA were combined with 4 μg of chemically synthesized template RNA and 4 ug of nicking gRNA in 5 μL of water. The transfection mix was added to 100,000 primary hepatocytes in Buffer P3 [Lonza], and cells were nucleofected using program DG-138. After nucleofection, cells were grown at 37° C., 5% $CO_2$ for 3 days prior to cell lysis and genomic DNA extraction. To analyze gene editing activity, primers flanking the target insertion site locus were used to amplify across the locus. Amplicons were analyzed via short read sequencing using an Illumina MiSeq. Conversion of T to C or C to A nucleotide indicated successful editing.

FIGS. 30A-30H show heatmaps of % rewriting for each combination of template RNA and second strand-targeting RNA, with FIGS. 30A-30D showing C to A rewriting and FIGS. 30E-30H showing T to C rewriting and grouped by the spacer of the template RNA. The results show that many combinations of exemplary template RNAs and exemplary second strand-targeting gRNAs facilitated installation of the silent mutations at R408 or P407 positions into cPAH gene of primary cyno hepatocytes. The results showed that for C to A editing, cPKU6 template RNAs showed the highest % rewriting compared to other spacers. For this edit, the second strand-targeting gRNA RNACS1906 showed the highest % rewriting combined with cPKU6 template RNAs (e.g., RNACS2827 template RNA combined with RNACS1906 showed 43% rewriting). The results showed that for T to C editing, cPKU5.2 template RNAs showed the highest % rewriting compared to other spacers, followed by cPKU6 template RNAs. For this edit, the second strand-targeting gRNA RNACS1810 showed the highest % rewriting combined with cPKU5.2 template RNAs (e.g., RNACS3349 template RNA combined with RNACS1810 showed 57% rewriting), whereas the second strand-targeting gRNA RNACS1906 showed the highest % rewriting combined with cPKU6 template RNAs.

Example 16: Evaluating Impact of Different Silent Substitutions on Rewriting Activity in Human iPSC-Derived Hepatoblasts This example describes the use of exemplary gene modifying systems containing a gene modifying polypeptide and template RNAs comprising four different spacers (hPKU3, hPKU4, hPKU5, and hPKU6), five lengths of heterologous object sequences, and three lengths of PBS sequences, wherein the template RNAs comprised one of five different silent substitutions. The example describes evaluation of the activity of template RNAs containing said silent substitutions to produce an W408R mutation to correct the R408W mutation in hPAH in CRISPR gene-edited iPSC-derived hepatoblast cells.

In this example, a template RNA contained:

(1) a gRNA spacer;

(2) a gRNA scaffold;

(3) a heterologous object sequence; and (4) a primer binding site (PBS) sequence.

Exemplary template RNAs generated and used are given in Table E6. Nucleotide modifications are noted as follows: phosphorothioate linkages denoted by an asterisk, 2'-O-methyl groups denoted by an 'm' preceding a nucleotide. The exemplary gene modifying polypeptide is RNAIVT338, comprising the amino acid sequence of SEQ ID NO: 30480.

TABLE E6

Exemplary Template RNAs with Various Silent Substitutions

| RNACS# | Name | IDT Notation | SEQ ID NO |
|---|---|---|---|
| RNACS 4741 | hPKU3 R25 P10 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrGrCrCrCrUrUrCrUrCrArGrUrUrCrG*mC*mU*mA | 30674 |
| RNACS 4742 | hPKU3 R25 P10 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrGrCrCrCrUrUrCrUrCrArGrUrUrCrG*mC*mU*mA | 30675 |

TABLE E6-continued

| Exemplary Template RNAs with Various Silent Substitutions | | | |
|---|---|---|---|
| RNACS# | Name | IDT Notation | SEQ ID NO |
| RNACS 4743 | hPKU3 R25 P10 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrUrCrGrGrCrCrCrUrUrCrUrCrArGrUrUrCrG*mC*mU*mA | 30676 |
| RNACS 4744 | hPKU3 R25 P10 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrCrCrCrCrUrUrCrUrCrArGrUrUrCrG*mC*mU*mA | 30677 |
| RNACS 4745 | hPKU3 R25 P10 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrCrCrCrCrUrUrCrUrCrArGrUrUrCrG*mC*mU*mA | 30678 |
| RNACS 4746 | hPKU3 R25 P10 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrCrCrCrArUrUrCrUrCrArGrUrUrCrG*mC*mU*mA | 30679 |
| RNACS 4747 | hPKU3 R23 P10 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrGrCrCrCrUrUrCrUrCrArGrUrUrCrG*mC*mU*mA | 30680 |
| RNACS 4748 | hPKU3 R23 P10 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrGrCrCrCrUrUrCrUrCrArGrUrUrCrG*mC*mU*mA | 30681 |
| RNACS 4749 | hPKU3 R23 P10 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrCrCrCrUrCrGrGrCrCrCrUrUrCrUrCrArGrUrUrCrG*mC*mU*mA | 30682 |
| RNACS 4750 | hPKU3 R23 P10 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrCrCrCrCrUrUrCrUrCrArGrUrUrCrG*mC*mU*mA | 30683 |
| RNACS 4751 | hPKU3 R23 P10 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrCrCrCrCrUrUrCrUrCrArGrUrUrCrG*mC*mU*mA | 30684 |
| RNACS 4752 | hPKU3 R23 P10 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrCrCrCrArUrUrCrUrCrArGrUrUrCrG*mC*mU*mA | 30685 |

TABLE E6-continued

Exemplary Template RNAs with Various Silent Substitutions

| RNACS# | Name | IDT Notation | SEQ ID NO |
|---|---|---|---|
| RNACS 4753 | hPKU3 R21 P10 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrGrCrCrCrUrUrCrUrCrArGrUrUrCrG*mC*mU*mA | 30686 |
| RNACS 4754 | hPKU3 R21 P10 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrGrCrCrCrUrUrCrUrCrArGrUrUrCrG*mC*mU*mA | 30687 |
| RNACS 4755 | hPKU3 R21 P10 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrCrCrCrUrCrGrGrCrCrCrUrUrCrUrCrArGrUrUrCrG*mC*mU*mA | 30688 |
| RNACS 4756 | hPKU3 R21 P10 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrCrCrCrCrUrUrCrUrCrArGrUrUrCrG*mC*mU*mA | 30689 |
| RNACS 4757 | hPKU3 R21 P10 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrCrUrUrCrUrCrArGrUrUrCrG*mC*mU*mA | 30690 |
| RNACS 4758 | hPKU3 R21 P10 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrArUrUrCrUrCrArGrUrUrCrG*mC*mU*mA | 30691 |
| RNACS 4759 | hPKU3 R19 P10 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrUrCrG*mC*mU*mA | 30692 |
| RNACS 4760 | hPKU3 R19 P10 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrGrCrCrCrUrUrCrUrCrArGrUrUrCrG*mC*mU*mA | 30693 |
| RNACS 4761 | hPKU3 R19 P10 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrCrGrGrCrCrCrUrUrCrUrCrArGrUrUrCrG*mC*mU*mA | 30694 |
| RNACS 4762 | hPKU3 R19 P10 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmC mAmCmCmGmAmGmUmCmGmGmUmGmCrArCrArArUrArCrCrUrCrGrCrCrCrCrUrUrCrUrCrArGrUrUrCrG*mC*mU*mA | 30695 |

TABLE E6-continued

Exemplary Template RNAs with Various Silent Substitutions

| RNACS# | Name | IDT Notation | SEQ ID NO |
|---|---|---|---|
| RNACS 4763 | hPKU3 R19 P10 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrCrUrUrCrUrCrArGrUrUrCrG*mC*mU*mA | 30696 |
| RNACS 4764 | hPKU3 R19 P10 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrArUrUrCrUrCrArGrUrUrCrG*mC*mU*mA | 30697 |
| RNACS 4765 | hPKU3 R17 P10 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrCrG*mC*mU*mA | 30698 |
| RNACS 4766 | hPKU3 R17 P10 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrGrCrCrCrUrUrCrUrCrArGrUrUrCrG*mC*mU*mA | 30699 |
| RNACS 4767 | hPKU3 R17 P10 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrCrGrGrCrCrCrUrUrCrUrCrArGrUrUrCrG*mC*mU*mA | 30700 |
| RNACS 4768 | hPKU3 R17 P10 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrCrCrCrCrUrUrCrUrCrArGrUrUrCrG*mC*mU*mA | 30701 |
| RNACS 4769 | hPKU3 R17 P10 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrCrCrCrCrUrUrCrUrCrArGrUrUrCrG*mC*mU*mA | 30702 |
| RNACS 4770 | hPKU3 R17 P10 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrCrCrCrArUrUrCrUrCrArGrUrUrCrG*mC*mU*mA | 30703 |
| RNACS 4771 | hPKU3 R25 P9 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrGrCrCrCrUrUrCrUrCrArGrUrUrC*mG*mC*mU | 30704 |
| RNACS 4772 | hPKU3 R25 P9 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrGrCrCrCrUrUrCrUrCrArGrUrUrC*mG*mC*mU | 30705 |

TABLE E6-continued

Exemplary Template RNAs with Various Silent Substitutions

| RNACS# | Name | IDT Notation | SEQ ID NO |
|---|---|---|---|
| RNACS 4773 | hPKU3 R25 P9 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrUrCrGrGrCrCrCrUrUrCrUrCrArGrUrUrC*mG*mC*mU | 30706 |
| RNACS 4774 | hPKU3 R25 P9 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrCrCrCrCrUrUrCrUrCrArGrUrUrC*mG*mC*mU | 30707 |
| RNACS 4775 | hPKU3 R25 P9 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrCrCrCrCrUrUrCrUrCrArGrUrUrC*mG*mC*mU | 30708 |
| RNACS 4776 | hPKU3 R25 P9 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrCrCrCrArUrUrCrUrCrArGrUrUrC*mG*mC*mU | 30709 |
| RNACS 4777 | hPKU3 R23 P9 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrGrCrCrCrUrUrCrUrCrArGrUrUrC*mG*mC*mU | 30710 |
| RNACS 4778 | hPKU3 R23 P9 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrGrCrCrCrUrUrCrUrCrArGrUrUrC*mG*mC*mU | 30711 |
| RNACS 4779 | hPKU3 R23 P9 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmC mAmCmCmGmAmGmUmCmGmGmUmGmCrUrGrCrCrArCrArArUrCrCrCrUrCrGrGrCrCrCrUrUrCrUrCrArGrUrUrC*mG*mC*mU | 30712 |
| RNACS 4780 | hPKU3 R23 P9 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrCrCrCrCrUrUrCrUrCrArGrUrUrC*mG*mC*mU | 30713 |
| RNACS 4781 | hPKU3 R23 P9 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrCrCrCrCrUrUrCrUrCrArGrUrUrC*mG*mC*mU | 30714 |
| RNACS 4782 | hPKU3 R23 P9 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrCrCrCrArUrUrCrUrCrArGrUrUrC*mG*mC*mU | 30715 |

TABLE E6-continued

Exemplary Template RNAs with Various Silent Substitutions

| RNACS# | Name | IDT Notation | SEQ ID NO |
|---|---|---|---|
| RNACS 4783 | hPKU3 R21 P9 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrGrCrCrCrUrUrCrUrCrArGrUrUrC*mG*mC*mU | 30716 |
| RNACS 4784 | hPKU3 R21 P9 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrGrCrCrCrUrUrCrUrCrArGrUrUrC*mG*mC*mU | 30717 |
| RNACS 4785 | hPKU3 R21 P9 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrCrCrCrUrCrGrGrCrCrCrUrUrCrUrCrArGrUrUrC*mG*mC*mU | 30718 |
| RNACS 4786 | hPKU3 R21 P9 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrCrCrCrCrUrUrCrUrCrArGrUrUrC*mG*mC*mU | 30719 |
| RNACS 4787 | hPKU3 R21 P9 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrCrUrUrCrUrCrArGrUrUrC*mG*mC*mU | 30720 |
| RNACS 4788 | hPKU3 R21 P9 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrArUrUrCrUrCrArGrUrUrC*mG*mC*mU | 30721 |
| RNACS 4789 | hPKU3 R19 P9 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrUrC*mG*mC*mU | 30722 |
| RNACS 4790 | hPKU3 R19 P9 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrGrCrCrCrUrUrCrUrCrArGrUrUrC*mG*mC*mU | 30723 |
| RNACS 4791 | hPKU3 R19 P9 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrCrGrGrCrCrCrUrUrCrUrCrArGrUrUrC*mG*mC*mU | 30724 |
| RNACS 4792 | hPKU3 R19 P9 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrCrCrCrCrUrUrCrUrCrArGrUrUrC*mG*mC*mU | 30725 |

TABLE E6-continued

Exemplary Template RNAs with Various Silent Substitutions

| RNACS# | Name | IDT Notation | SEQ ID NO |
|---|---|---|---|
| RNACS 4793 | hPKU3 R19 P9 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrCrUrUrCrUrCrArGrUrUrC*mG*mC*mU | 30726 |
| RNACS 4794 | hPKU3 R19 P9 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrArUrUrCrUrCrArGrUrUrC*mG*mC*mU | 30727 |
| RNACS 4795 | hPKU3 R17 P9 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrC*mG*mC*mU | 30728 |
| RNACS 4796 | hPKU3 R17 P9 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrGrCrCrCrUrUrCrUrCrArGrUrUrC*mG*mC*mU | 30729 |
| RNACS 4797 | hPKU3 R17 P9 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrCrCrCrUrCrGrGrCrCrCrUrUrCrUrCrArGrUrUrC*mG*mC*mU | 30730 |
| RNACS 4798 | hPKU3 R17 P9 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrCrCrCrCrUrUrCrUrCrArGrUrUrC*mG*mC*mU | 30731 |
| RNACS 4799 | hPKU3 R17 P9 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrCrCrCrCrUrUrCrUrCrArGrUrUrC*mG*mC*mU | 30732 |
| RNACS 4800 | hPKU3 R17 P9 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrCrCrCrArUrUrCrUrCrArGrUrUrC*mG*mC*mU | 30733 |
| RNACS 4801 | hPKU3 R25 P8 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrGrCrCrCrUrUrCrUrCrArGrUrU*mC*mG*mC | 30734 |
| RNACS 4802 | hPKU3 R25 P8 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrGrCrCrCrUrUrCrUrCrArGrUrU*mC*mG*mC | 30735 |
| RNACS 4803 | hPKU3 R25 P8 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrUrCrGrGrCrCrCrUrUrCrUrCrArGrUrU*mC*mG*mC | 30736 |
| RNACS 4804 | hPKU3 R25 P8 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCr | 30737 |

TABLE E6-continued

Exemplary Template RNAs with Various Silent Substitutions

| RNACS# | Name | IDT Notation | SEQ ID NO |
|---|---|---|---|
| | | UrGrCrCrArCrArArUrArCrCrUrCrGrCrCrCrCrUrUrCrUrCrAr<br>GrUrU*mC*mG*mC | |
| RNACS<br>4805 | hPKU3<br>R25 P8<br>sub7 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrGrCrGrCrCrCrCrUrUrCrUrCrAr<br>GrUrU*mC*mG*mC | 30738 |
| RNACS<br>4806 | hPKU3<br>R25 P8<br>sub8 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrGrCrGrCrCrCrArUrUrCrUrCrAr<br>GrUrU*mC*mG*mC | 30739 |
| RNACS<br>4807 | hPKU3<br>R23 P8<br>sub0 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrUrCrGrGrCrCrCrUrUrCrUrCrArGrUr<br>U*mC*mG*mC | 30740 |
| RNACS<br>4808 | hPKU3<br>R23 P8<br>sub1 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrGrCrGrGrCrCrCrUrUrCrUrCrArGrUr<br>U*mC*mG*mC | 30741 |
| RNACS<br>4809 | hPKU3<br>R23 P8<br>sub2 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrCrCrCrUrCrGrGrCrCrCrUrUrCrUrCrArGrUr<br>U*mC*mG*mC | 30742 |
| RNACS<br>4810 | hPKU3<br>R23 P8<br>sub4 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrUrCrGrCrCrCrCrUrUrCrUrCrArGrUr<br>U*mC*mG*mC | 30743 |
| RNACS<br>4811 | hPKU3<br>R23 P8<br>sub7 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrGrCrGrCrCrCrCrUrUrCrUrCrArGrUr<br>U*mC*mG*mC | 30744 |
| RNACS<br>4812 | hPKU3<br>R23 P8<br>sub8 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrGrCrGrCrCrCrArUrUrCrUrCrArGrUr<br>U*mC*mG*mC | 30745 |
| RNACS<br>4813 | hPKU3<br>R21 P8<br>sub0 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrUrCrGrGrCrCrCrUrUrCrUrCrArGrUrU*mC<br>*mG*mC | 30746 |
| RNACS<br>4814 | hPKU3<br>R21 P8<br>sub1 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrGrCrGrGrCrCrCrUrUrCrUrCrArGrUrU*mC<br>*mG*mc | 30747 |
| RNACS<br>4815 | hPKU3<br>R21 P8 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr | 30748 |

TABLE E6-continued

Exemplary Template RNAs with Various Silent Substitutions

| RNACS# | Name | IDT Notation | SEQ ID NO |
|---|---|---|---|
| | sub2 | ArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrCrCrCrUrCrGrGrCrCrCrUrUrCrUrCrArGrUrU*mC*mG*mC | |
| RNACS 4816 | hPKU3 R21 P8 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrCrCrCrCrUrUrCrUrCrArGrUrU*mC*mG*mc | 30749 |
| RNACS 4817 | hPKU3 R21 P8 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrCrUrUrCrUrCrArGrUrU*mC*mG*mc | 30750 |
| RNACS 4818 | hPKU3 R21 P8 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrArUrUrCrUrCrArGrUrU*mC*mG*mC | 30751 |
| RNACS 4819 | hPKU3 R19 P8 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrU*mC*mG*mC | 30752 |
| RNACS 4820 | hPKU3 R19 P8 sub1 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrGrCrCrCrUrUrCrUrCrArGrUrUmC*mG*mC | 30753 |
| RNACS 4821 | hPKU3 R19 P8 sub2 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrCrGrGrCrCrCrUrUrCrUrCrArGrUrU*mC*mG*mC | 30754 |
| RNACS 4822 | hPKU3 R19 P8 sub4 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrCrCrCrCrUrUrCrUrCrArGrUrU*mC*mG*mC | 30755 |
| RNACS 4823 | hPKU3 R19 P8 sub7 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrCrUrUrCrUrCrArGrUrU*mC*mG*mC | 30756 |
| RNACS 4824 | hPKU3 R19 P8 sub8 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrArUrUrCrUrCrArGrUrU*mC*mG*mC | 30757 |
| RNACS 4825 | hPKU3 R17 P8 sub0 | mU*mG*mG*rGrUrCrGrUrArGrCrGrArArCrUrGrArGrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrU*mC*mG*mC | 30758 |

TABLE E6-continued

Exemplary Template RNAs with Various Silent Substitutions

| RNACS# | Name | IDT Notation | SEQ ID NO |
|---|---|---|---|
| RNACS 4826 | hPKU3 R17 P8 sub1 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrGrCrGrGrCrCrCrUrUrCrUrCrArGrUrU*mC*mG*mC | 30759 |
| RNACS 4827 | hPKU3 R17 P8 sub2 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrCrCrCrUrCrGrGrCrCrCrUrUrCrUrCrArGrUrU*mC*mG*mC | 30760 |
| RNACS 4828 | hPKU3 R17 P8 sub4 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrUrCrGrCrCrCrCrUrUrCrUrCrArGrUrU*mC*mG*mC | 30761 |
| RNACS 4829 | hPKU3 R17 P8 sub7 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrGrCrGrCrCrCrCrUrUrCrUrCrArGrUrU*mC*mG*mC | 30762 |
| RNACS 4830 | hPKU3 R17 P8 sub8 | mU*mG*mG*rGrUrCrGrUrArGrCrGrArArCrUrGrArGrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrGrCrGrCrCrCrArUrUrCrUrCrArGrUrU*mC*mG*mC | 30763 |
| RNACS 4831 | hPKU4 R24 P10 sub0 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrUrCrGrGrCrCrCrUrUrCrUrCrAr<br>GrUrUrC*mG*mC*mU | 30764 |
| RNACS 4832 | hPKU4 R24 P10 sub1 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrGrCrGrGrCrCrCrUrUrCrUrCrAr<br>GrUrUrC*mG*mC*mU | 30765 |
| RNACS 4833 | hPKU4 R24 P10 sub4 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrUrCrGrCrCrCrCrUrUrCrUrCrAr<br>GrUrUrC*mG*mC*mU | 30766 |
| RNACS 4834 | hPKU4 R24 P10 sub5 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrUrCrGrCrCrCrArUrUrCrUrCrAr<br>GrUrUrC*mG*mC*mU | 30767 |
| RNACS 4835 | hPKU4 R24 P10 sub7 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrGrCrGrCrCrCrCrUrUrCrUrCrAr<br>GrUrUrC*mG*mC*mU | 30768 |
| RNACS 4836 | hPKU4 R24 P10 sub8 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrGrCrGrCrCrCrArUrUrCrUrCrAr<br>GrUrUrC*mG*mC*mU | 30769 |
| RNACS 4837 | hPKU4 R22 P10 sub0 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm | 30770 |

TABLE E6-continued

Exemplary Template RNAs with Various Silent Substitutions

| RNACS# | Name | IDT Notation | SEQ ID NO |
|---|---|---|---|
| | | AmAmAmAmAmGmUmGmGmCmAmCmCmGmAmGmUmCmGmGmUmGmCrUrGrCrCrArCrArArUrArCrCrUrCrGrGrCrCrCrUrUrCrUrCrArGrUrUrC*mG*mC*mU | |
| RNACS 4838 | hPKU4 R22 P10 sub1 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrGrCrCrCrUrUrCrUrCrArGrUrUrC*mG*mC*mU | 30771 |
| RNACS 4839 | hPKU4 R22 P10 sub4 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrCrCrCrCrUrUrCrUrCrArGrUrUrC*mG*mC*mU | 30772 |
| RNACS 4840 | hPKU4 R22 P10 sub5 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrCrCrCrArUrUrCrUrCrArGrUrUrC*mG*mC*mU | 30773 |
| RNACS 4841 | hPKU4 R22 P10 sub7 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrCrCrCrCrUrUrCrUrCrArGrUrUrC*mG*mC*mU | 30774 |
| RNACS 4842 | hPKU4 R22 P10 sub8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrCrCrCrArUrUrCrUrCrArGrUrUrC*mG*mC*mU | 30775 |
| RNACS 4843 | hPKU4 R20 P10 sub0 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrGrCrCrCrUrUrCrUrCrArGrUrUrC*mG*mC*mU | 30776 |
| RNACS 4844 | hPKU4 R20 P10 sub1 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrGrCrCrCrUrUrCrUrCrArGrUrUrC*mG*mC*mU | 30777 |
| RNACS 4845 | hPKU4 R20 P10 sub4 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrCrCrCrCrUrUrCrUrCrArGrUrUrC*mG*mC*mU | 30778 |
| RNACS 4846 | hPKU4 R20 P10 sub5 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrCrCrCrArUrUrCrUrCrArGrUrUrC*mG*mC*mU | 30779 |
| RNACS 4847 | hPKU4 R20 P10 sub7 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrCrUrUrCrUrCrArGrUrUrC*mG*mC*mU | 30780 |

TABLE E6-continued

Exemplary Template RNAs with Various Silent Substitutions

| RNACS# | Name | IDT Notation | SEQ ID NO |
|---|---|---|---|
| RNACS 4848 | hPKU4 R20 P10 sub8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrArUrUrCrUrCrArGrUrUrC*mG*mC*mU | 30781 |
| RNACS 4849 | hPKU4 R18 P10 sub0 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrUrC*mG*mC*mU | 30782 |
| RNACS 4850 | hPKU4 R18 P10 sub1 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrGrCrCrCrUrUrCrUrCrArGrUrUrC*mG*mC*mU | 30783 |
| RNACS 4851 | hPKU4 R18 P10 sub4 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrCrCrCrCrUrUrCrUrCrArGrUrUrC*mG*mC*mU | 30784 |
| RNACS 4852 | hPKU4 R18 P10 sub5 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrCrCrCrArUrUrCrUrCrArGrUrUrC*mG*mC*mU | 30785 |
| RNACS 4853 | hPKU4 R18 P10 sub7 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrCrUrUrCrUrCrArGrUrUrC*mG*mC*mU | 30786 |
| RNACS 4854 | hPKU4 R18 P10 sub8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrArUrUrCrUrCrArGrUrUrC*mG*mC*mU | 30787 |
| RNACS 4855 | hPKU4 R16 P10 sub0 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrUrUrC*mG*mC*mU | 30788 |
| RNACS 4856 | hPKU4 R16 P10 sub1 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrGrCrCrCrUrUrCrUrCrArGrUrUrC*mG*mC*mU | 30789 |
| RNACS 4857 | hPKU4 R16 P10 sub4 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrCrCrCrCrUrUrCrUrCrArGrUrUrC*mG*mC*mU | 30790 |
| RNACS 4858 | hPKU4 R16 P10 sub5 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrCrCrCrArUrUrCrUrCrArGrUrUrC*mG*mC*mU | 30791 |

TABLE E6-continued

Exemplary Template RNAs with Various Silent Substitutions

| RNACS# | Name | IDT Notation | SEQ ID NO |
|---|---|---|---|
| RNACS 4859 | hPKU4 R16 P10 sub7 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrCrCrCrCrUrUrCrUrCrArGrUrUrC*mG*mC*mU | 30792 |
| RNACS 4860 | hPKU4 R16 P10 sub8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrCrCrCrArUrUrCrUrCrArGrUrUrC*mG*mC*mU | 30793 |
| RNACS 4861 | hPKU4 R24 P9 sub0 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrGrCrCrCrUrUrCrUrCrArGrUrU*mC*mG*mC | 30794 |
| RNACS 4862 | hPKU4 R24 P9 sub1 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrGrCrCrCrUrUrCrUrCrArGrUrU*mC*mG*mC | 30795 |
| RNACS 4863 | hPKU4 R24 P9 sub4 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrCrCrCrCrUrUrCrUrCrArGrUrU*mC*mG*mC | 30796 |
| RNACS 4864 | hPKU4 R24 P9 sub5 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrCrCrCrArUrUrCrUrCrArGrUrU*mC*mG*mC | 30797 |
| RNACS 4865 | hPKU4 R24 P9 sub7 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrCrCrCrCrUrUrCrUrCrArGrUrU*mC*mG*mC | 30798 |
| RNACS 4866 | hPKU4 R24 P9 sub8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrCrCrCrArUrUrCrUrCrArGrUrU*mC*mG*mC | 30799 |
| RNACS 4867 | hPKU4 R22 P9 sub0 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrGrCrCrCrUrUrCrUrCrArGrUrU*mC*mG*mC | 30800 |
| RNACS 4868 | hPKU4 R22 P9 sub1 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrGrCrCrCrUrUrCrUrCrArGrUrU*mC*mG*mC | 30801 |
| RNACS 4869 | hPKU4 R22 P9 sub4 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrCrCrCrCrUrUrCrUrCrArGrUrU*mC*mG*mC | 30802 |

TABLE E6-continued

Exemplary Template RNAs with Various Silent Substitutions

| RNACS# | Name | IDT Notation | SEQ ID NO |
| --- | --- | --- | --- |
| RNACS 4870 | hPKU4 R22 P9 sub5 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrCrCrCrArUrUrCrUrCrArGrUrU*mC*mG*mC | 30803 |
| RNACS 4871 | hPKU4 R22 P9 sub7 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrCrCrCrCrUrUrCrUrCrArGrUrU*mC*mG*mC | 30804 |
| RNACS 4872 | hPKU4 R22 P9 sub8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrCrCrCrArUrUrCrUrCrArGrUrU*mC*mG*mC | 30805 |
| RNACS 4873 | hPKU4 R20 P9 sub0 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrGrCrCrCrUrUrCrUrCrArGrUrU*mC*mG*mc | 30806 |
| RNACS 4874 | hPKU4 R20 P9 sub1 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrGrCrCrCrUrUrCrUrCrArGrUrU*mC*mG*mC | 30807 |
| RNACS 4875 | hPKU4 R20 P9 sub4 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrCrCrCrCrUrUrCrUrCrArGrUrU*mC*mG*mc | 30808 |
| RNACS 4876 | hPKU4 R20 P9 sub5 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrCrCrCrArUrUrCrUrCrArGrUrU*mC*mG*mC | 30809 |
| RNACS 4877 | hPKU4 R20 P9 sub7 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrCrUrUrCrUrCrArGrUrU*mC*mG*mC | 30810 |
| RNACS 4878 | hPKU4 R20 P9 sub8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrCrCrCrArUrUrCrUrCrArGrUrU*mC*mG*mC | 30811 |
| RNACS 4879 | hPKU4 R18 P9 sub0 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrCrUrCrArGrUrU*mC*mG*mC | 30812 |

TABLE E6-continued

Exemplary Template RNAs with Various Silent Substitutions

| RNACS# | Name | IDT Notation | SEQ ID NO |
|---|---|---|---|
| RNACS 4880 | hPKU4 R18 P9 sub1 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrGrCrGrGrCrCrCrUrUrCrUrCrArGrUrU*mC*mG*<br>mC | 30813 |
| RNACS 4881 | hPKU4 R18 P9 sub4 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrUrCrGrCrCrCrCrUrUrCrUrCrArGrUrUmC*mG*m<br>C | 30814 |
| RNACS 4882 | hPKU4 R18 P9 sub5 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrUrCrGrCrCrCrArUrUrCrUrCrArGrUrU*mC*mG*<br>mC | 30815 |
| RNACS 4883 | hPKU4 R18 P9 sub7 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrGrCrGrCrCrCrCrUrUrCrUrCrArGrUrU*mC*mG*<br>mC | 30816 |
| RNACS 4884 | hPKU4 R18 P9 sub8 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrGrCrGrCrCrCrArUrUrCrUrCrArGrUrU*mC*mG*<br>mC | 30817 |
| RNACS 4885 | hPKU4 R16 P9 sub0 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrUrCrGrGrCrCrCrUrUrCrUrCrArGrUrU*mC*mG*mC | 30818 |
| RNACS 4886 | hPKU4 R16 P9 sub1 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrGrCrGrGrCrCrCrUrUrCrUrCrArGrUrU*mC*mG*mC | 30819 |
| RNACS 4887 | hPKU4 R16 P9 sub4 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrUrCrGrCrCrCrCrUrUrCrUrCrArGrUrU*mC*mG*mC | 30820 |
| RNACS 4888 | hPKU4 R16 P9 sub5 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrUrCrGrCrCrCrArUrUrCrUrCrArGrUrUmC*mG*mC | 30821 |
| RNACS 4889 | hPKU4 R16 P9 sub7 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrGrCrGrCrCrCrCrUrUrCrUrCrArGrUrU*mC*mG*mC | 30822 |
| RNACS 4890 | hPKU4 R16 P9 sub8 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArAr<br>UrArCrCrGrCrGrCrCrCrArUrUrCrUrCrArGrUrU*mC*mG*mC | 30823 |
| RNACS 4891 | hPKU4 R24 P8 sub0 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr | 30824 |

TABLE E6-continued

Exemplary Template RNAs with Various Silent Substitutions

| RNACS# | Name | IDT Notation | SEQ ID NO |
|---|---|---|---|
| | | UrGrCrCrArCrArArUrArCrCrUrCrGrGrCrCrCrUrUrCrUrCrAr<br>GrU*mU*mC*mG | |
| RNACS 4892 | hPKU4 R24 P8 sub1 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrGrCrGrGrCrCrCrUrUrCrUrCrAr<br>GrU*mU*mC*mG | 30825 |
| RNACS 4893 | hPKU4 R24 P8 sub4 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrUrCrGrCrCrCrCrUrUrCrUrCrAr<br>GrU*mU*mC*mG | 30826 |
| RNACS 4894 | hPKU4 R24 P8 sub5 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrUrCrGrCrCrCrArUrUrCrUrCrAr<br>GrU*mU*mC*mG | 30827 |
| RNACS 4895 | hPKU4 R24 P8 sub7 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrGrCrGrCrCrCrCrUrUrCrUrCrAr<br>GrU*mU*mC*mG | 30828 |
| RNACS 4896 | hPKU4 R24 P8 sub8 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrGrCrGrCrCrCrArUrUrCrUrCrAr<br>GrU*mU*mC*mG | 30829 |
| RNACS 4897 | hPKU4 R22 P8 sub0 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrUrCrGrGrCrCrCrUrUrCrUrCrArGrU*<br>mU*mC*mG | 30830 |
| RNACS 4898 | hPKU4 R22 P8 sub1 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrGrCrGrGrCrCrCrUrUrCrUrCrArGrU*<br>mU*mC*mG | 30831 |
| RNACS 4899 | hPKU4 R22 P8 sub4 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrUrCrGrCrCrCrCrUrUrCrUrCrArGrU*<br>mU*mC*mG | 30832 |
| RNACS 4900 | hPKU4 R22 P8 sub5 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrUrCrGrCrCrCrArUrUrCrUrCrArGrU*<br>mU*mC*mG | 30833 |
| RNACS 4901 | hPKU4 R22 P8 sub7 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrGrCrGrCrCrCrCrUrUrCrUrCrArGrU*<br>mU*mC*mG | 30834 |
| RNACS 4902 | hPKU4 R22 P8 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr | 30835 |

TABLE E6-continued

Exemplary Template RNAs with Various Silent Substitutions

| RNACS# | Name | IDT Notation | SEQ ID NO |
|---|---|---|---|
| | sub8 | ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrGrCrGrCrCrCrArUrUrCrUrCrArGrU*<br>mU*mC*mG | |
| RNACS 4903 | hPKU4 R20 P8 sub0 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrUrCrGrGrCrCrCrUrUrCrUrCrArGrU*mU*m<br>C*mG | 30836 |
| RNACS 4904 | hPKU4 R20 P8 sub1 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrGrCrGrGrCrCrCrUrUrCrUrCrArGrU*mU*m<br>C*mG | 30837 |
| RNACS 4905 | hPKU4 R20 P8 sub4 | mG*mG*mG*rUrCrGrUrArGrCrGrArArCrUrGrArGrArArGrUrUr<br>UrUrArGrAmGmCmUmAmGmAmAmAmUmAmGmCr<br>ArArGrUrUrArArArArUrArArGrGrCrUrArGrUrCrCrGrUrUrAr<br>UrCrAmAmCmUmUmGmAmAmAmAmAmGmUmGmGmCmAmCmCmGmAmGmUm<br>CmGmGmUmGmCrCrCrArCrArArUrArCrCrUrCrGrCrCrCrCrUrUr<br>CrUrCrArGrU*mU*mC*mG | 30838 |
| RNACS 4906 | hPKU4 R20 P8 sub5 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrUrCrGrCrCrCrArUrUrCrUrCrArGrU*mU*m<br>C*mG | 30839 |
| RNACS 4907 | hPKU4 R20 P8 sub7 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrGrCrGrCrCrCrCrUrUrCrUrCrArGrU*mU*m<br>C*mG | 30840 |
| RNACS 4908 | hPKU4 R20 P8 sub8 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrGrCrGrCrCrCrArUrUrCrUrCrArGrU*mU*m<br>C*mG | 30841 |
| RNACS 4909 | hPKU4 R18 P8 sub0 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrUrCrGrGrCrCrCrUrUrCrUrCrArGrU*mU*mC*mG | 30842 |
| RNACS 4910 | hPKU4 R18 P8 sub1 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrGrCrGrGrCrCrCrUrUrCrUrCrArGrU*mU*mC*mG | 30843 |
| RNACS 4911 | hPKU4 R18 P8 sub4 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrUrCrGrCrCrCrCrUrUrCrUrCrArGrU*mU*mC*mG | 30844 |
| RNACS 4912 | hPKU4 R18 P8 sub5 | mG*mG*mG*rUrCrGrUrArGrCrGrArArCrUrGrArGrArArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrUrCrGrCrCrCrArUrUrCrUrCrArGrU*mU*mC*mG | 30845 |

TABLE E6-continued

Exemplary Template RNAs with Various Silent Substitutions

| RNACS# | Name | IDT Notation | SEQ ID NO |
|---|---|---|---|
| RNACS 4913 | hPKU4 R18 P8 sub7 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrCrUrUrCrUrCrArGrU*mU*mC*mG | 30846 |
| RNACS 4914 | hPKU4 R18 P8 sub8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrCrCrCrArUrUrCrUrCrArGrU*mU*mC*mG | 30847 |
| RNACS 4915 | hPKU4 R16 P8 sub0 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrGrCrCrCrUrUrCrUrCrArGrU*mU*mC*mG | 30848 |
| RNACS 4916 | hPKU4 R16 P8 sub1 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrGrCrCrCrUrUrCrUrCrArGrU*mU*mC*mG | 30849 |
| RNACS 4917 | hPKU4 R16 P8 sub4 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrCrCrCrCrUrUrCrUrCrArGrU*mU*mC*mG | 30850 |
| RNACS 4918 | hPKU4 R16 P8 sub5 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrUrCrGrCrCrCrArUrUrCrUrCrArGrU*mU*mC*mG | 30851 |
| RNACS 4919 | hPKU4 R16 P8 sub7 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrCrCrCrCrUrUrCrUrCrArGrU*mU*mC*mG | 30852 |
| RNACS 4920 | hPKU4 R16 P8 sub8 | mG*mG*mG*rUrCrGrUrArGrCrGrArArCrUrGrArGrArArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArUrArCrCrGrCrGrCrCrCrArUrUrCrUrCrArGrU*mU*mC*mG | 30853 |
| RNACS 4923 | hPKU5 R20 P10 sub0 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrUrCrGrGrCrCrCrUrUrCrU*mC*mA*mG | 30854 |
| RNACS 4924 | hPKU5 R20 P10 sub1 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrGrCrGrGrCrCrCrUrUrCrU*mC*mA*mG | 30855 |
| RNACS 4925 | hPKU5 R20 P10 sub2 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrCrCrCrUrCrGrGrCrCrCrUrUrCrU*mC*mA*mG | 30856 |
| RNACS 4926 | hPKU5 R20 P10 sub3 | mU*mA*mG*rCrGrArArCrUrGrArGrArArGrGrGrCrCrArGrUrUrUrUrArGrAmGmCmUmAmGmAmAmAmUmAmGmCrA rArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrCrCrCrGrCrGrGrCrCrCrUrUrCrU*mC*mA*mG | 30857 |

TABLE E6-continued

Exemplary Template RNAs with Various Silent Substitutions

| RNACS# | Name | IDT Notation | SEQ ID NO |
|---|---|---|---|
| RNACS 4927 | hPKU5 R20 P10 sub4 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrUrCrGrCrCrCrCrUrUrCrU*mC*mA*mG | 30858 |
| RNACS 4928 | hPKU5 R20 P10 sub7 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrGrArUrArCrCrUrCrGrGrCrCrCrUrUrCrU*mC*mA*mG | 30859 |
| RNACS 4929 | hPKU5 R18 P10 sub0 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrGrCrCrCrUrUrCrU*mC*mA*mG | 30860 |
| RNACS 4930 | hPKU5 R18 P10 sub1 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrGrCrCrCrUrUrCrU*mC*mA*mG | 30861 |
| RNACS 4931 | hPKU5 R18 P10 sub2 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrUrCrGrGrCrCrCrUrUrCrU*mC*mA*mG | 30862 |
| RNACS 4932 | hPKU5 R18 P10 sub3 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrGrCrGrGrCrCrCrUrUrCrU*mC*mA*mG | 30863 |
| RNACS 4933 | hPKU5 R18 P10 sub4 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrCrCrCrCrUrUrCrU*mC*mA*mG | 30864 |
| RNACS 4934 | hPKU5 R18 P10 sub7 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrGrArUrArCrCrUrCrGrGrCrCrCrUrUrCrU*mC*mA*mG | 30865 |
| RNACS 4935 | hPKU5 R16 P10 sub0 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrGrCrCrCrUrUrCrU*mC*mA*mG | 30866 |
| RNACS 4936 | hPKU5 R16 P10 sub1 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrGrCrCrCrUrUrCrU*mC*mA*mG | 30867 |
| RNACS 4937 | hPKU5 R16 P10 sub2 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrCrCrCrUrCrGrGrCrCrCrUrUrCrU*mC*mA*mG | 30868 |

TABLE E6-continued

Exemplary Template RNAs with Various Silent Substitutions

| RNACS# | Name | IDT Notation | SEQ ID NO |
|---|---|---|---|
| RNACS 4938 | hPKU5 R16 P10 sub3 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrCrCrCrGrCrGrGrCrCrCrUrUrCrU*mC*mA*mG | 30869 |
| RNACS 4939 | hPKU5 R16 P10 sub4 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrUrCrGrCrCrCrCrUrUrCrU*mC*mA*mG | 30870 |
| RNACS 4940 | hPKU5 R16 P10 sub7 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrGrArUrArCrCrUrCrGrGrCrCrCrUrUrCrU*mC*mA*mG | 30871 |
| RNACS 4941 | hPKU5 R14 P10 sub0 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrUrCrGrGrCrCrCrUrUrCrU*mC*mA*mG | 30872 |
| RNACS 4942 | hPKU5 R14 P10 sub1 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrGrCrGrGrCrCrCrUrUrCrU*mC*mA*mG | 30873 |
| RNACS 4943 | hPKU5 R14 P10 sub2 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrCrCrCrUrCrGrGrCrCrCrUrUrCrU*mC*mA*mG | 30874 |
| RNACS 4944 | hPKU5 R14 P10 sub3 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrCrCrCrGrCrGrGrCrCrCrUrUrCrU*mC*mA*mG | 30875 |
| RNACS 4945 | hPKU5 R14 P10 sub4 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrUrCrGrCrCrCrCrUrUrCrU*mC*mA*mG | 30876 |
| RNACS 4946 | hPKU5 R14 P10 sub7 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrGrArUrArCrCrUrCrGrGrCrCrCrUrUrCrU*mC*mA*mG | 30877 |
| RNACS 4947 | hPKU5 R12 P10 sub0 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrUrCrGrGrCrCrCrUrUrCrU*mC*mA*mG | 30878 |
| RNACS 4948 | hPKU5 R12 P10 sub1 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrGrCrGrGrCrCrCrUrUrCrU*mC*mA*mG | 30879 |
| RNACS 4949 | hPKU5 R12 P10 sub2 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrCrCrCrUrCrGrGrCrCrCrUrUrCrU*mC*mA*mG | 30880 |
| RNACS 4950 | hPKU5 R12 P10 sub3 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm | 30881 |

TABLE E6-continued

Exemplary Template RNAs with Various Silent Substitutions

| RNACS# | Name | IDT Notation | SEQ ID NO |
|---|---|---|---|
| | | AmAmAmAmAmGmUmGmGmCmAmCmCmGmAmGmUmCmGmGmUmGmCrArCrArArUrCrCrCrGrCrGrGrCrCrCrUrUrCrU*mC*mA*mG | |
| RNACS 4951 | hPKU5 R12 P10 sub4 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrCrCrCrCrUrUrCrU*mC*mA*mG | 30882 |
| RNACS 4952 | hPKU5 R12 P10 sub7 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrGrArUrArCrCrUrCrGrGrCrCrCrUrUrCrU*mC*mA*mG | 30883 |
| RNACS 4953 | hPKU5 R20 P9 sub0 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrUrCrGrGrCrCrCrUrUrC*mU*mC*mA | 30884 |
| RNACS 4954 | hPKU5 R20 P9 sub1 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrGrCrGrGrCrCrCrUrUrC*mU*mC*mA | 30885 |
| RNACS 4955 | hPKU5 R20 P9 sub2 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrCrCrCrUrCrGrGrCrCrCrUrUrC*mU*mC*mA | 30886 |
| RNACS 4956 | hPKU5 R20 P9 sub3 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrCrCrCrGrCrGrGrCrCrCrUrUrC*mU*mC*mA | 30887 |
| RNACS 4957 | hPKU5 R20 P9 sub4 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrUrCrGrCrCrCrCrUrUrC*mU*mC*mA | 30888 |
| RNACS 4958 | hPKU5 R20 P9 sub7 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrGrArUrArCrCrUrCrGrGrCrCrCrUrUrC*mU*mC*mA | 30889 |
| RNACS 4959 | hPKU5 R18 P9 sub0 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrGrCrCrCrUrUrC*mU*mC*mA | 30890 |
| RNACS 4960 | hPKU5 R18 P9 sub1 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrGrCrGrGrCrCrCrUrUrC*mU*mC*mA | 30891 |

TABLE E6-continued

Exemplary Template RNAs with Various Silent Substitutions

| RNACS# | Name | IDT Notation | SEQ ID NO |
|---|---|---|---|
| RNACS 4961 | hPKU5 R18 P9 sub2 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrUrCrGrGrCrCrCrUrUrC*mU*mC*mA | 30892 |
| RNACS 4962 | hPKU5 R18 P9 sub3 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrCrCrCrGrCrGrGrCrCrCrUrUrC*mU*mC*mA | 30893 |
| RNACS 4963 | hPKU5 R18 P9 sub4 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrArArUrArCrCrUrCrGrCrCrCrCrUrUrC*mU*mC*mA | 30894 |
| RNACS 4964 | hPKU5 R18 P9 sub7 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrCrUrGrCrCrArCrGrArUrArCrCrUrCrGrGrCrCrCrUrUrC*mU*mC*mA | 30895 |
| RNACS 4965 | hPKU5 R16 P9 sub0 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrGrCrCrCrUrUrC*mU*mC*mA | 30896 |
| RNACS 4966 | hPKU5 R16 P9 sub1 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrGrCrGrGrCrCrCrUrUrC*mU*mC*mA | 30897 |
| RNACS 4967 | hPKU5 R16 P9 sub2 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrCrCrCrUrCrGrGrCrCrCrUrUrC*mU*mC*mA | 30898 |
| RNACS 4968 | hPKU5 R16 P9 sub3 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrCrCrCrGrCrGrGrCrCrCrUrUrC*mU*mC*mA | 30899 |
| RNACS 4969 | hPKU5 R16 P9 sub4 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrArArUrArCrCrUrCrGrCrCrCrCrUrUrC*mU*mC*mA | 30900 |
| RNACS 4970 | hPKU5 R16 P9 sub7 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrGrCrCrArCrGrArUrArCrCrUrCrGrGrCrCrCrUrUrC*mU*mC*mA | 30901 |
| RNACS 4971 | hPKU5 R14 P9 sub0 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrGrCrCrCrUrUrC*mU*mC*mA | 30902 |
| RNACS 4972 | hPKU5 R14 P9 sub1 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrGrCrGrGrCrCrCrUrUrC*mU*mC*mA | 30903 |

TABLE E6-continued

Exemplary Template RNAs with Various Silent Substitutions

| RNACS# | Name | IDT Notation | SEQ ID NO |
|---|---|---|---|
| RNACS 4973 | hPKU5 R14 P9 sub2 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrCrCrCrUrCrGrGrCrCrCrUrUrC*mU*mC*mA | 30904 |
| RNACS 4974 | hPKU5 R14 P9 sub3 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrCrCrCrGrCrGrGrCrCrCrUrUrC*mU*mC*mA | 30905 |
| RNACS 4975 | hPKU5 R14 P9 sub4 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrArArUrArCrCrUrCrGrCrCrCrCrUrUrC*mU*mC*mA | 30906 |
| RNACS 4976 | hPKU5 R14 P9 sub7 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrCrArCrGrArUrArCrCrUrCrGrGrCrCrCrUrUrC*mU*mC*mA | 30907 |
| RNACS 4977 | hPKU5 R12 P9 sub0 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrGrCrCrCrUrUrC*mU*mC*mA | 30908 |
| RNACS 4978 | hPKU5 R12 P9 sub1 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrGrCrGrGrCrCrCrUrUrC*mU*mC*mA | 30909 |
| RNACS 4979 | hPKU5 R12 P9 sub2 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrCrGrGrCrCrCrUrUrC*mU*mC*mA | 30910 |
| RNACS 4980 | hPKU5 R12 P9 sub3 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrGrCrGrGrCrCrCrUrUrC*mU*mC*mA | 30911 |
| RNACS 4981 | hPKU5 R12 P9 sub4 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrCrCrCrCrUrUrC*mU*mC*mA | 30912 |
| RNACS 4982 | hPKU5 R12 P9 sub7 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrGrArUrArCrCrUrCrGrGrCrCrCrUrUrC*mU*mC*mA | 30913 |
| RNACS 4983 | hPKU5 R20 P8 sub0 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrUrCrGrGrCrCrCrUrU*mC*mU*mC | 30914 |
| RNACS 4984 | hPKU5 R20 P8 sub1 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrUrUrGrCrUrGrCrCrArCrArArUrArCrCrGrCrGrGrCrCrCrUrU*mC*mU*mC | 30915 |

TABLE E6-continued

Exemplary Template RNAs with Various Silent Substitutions

| RNACS# | Name | IDT Notation | SEQ ID NO |
|---|---|---|---|
| RNACS 4985 | hPKU5 R20 P8 sub2 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrUr<br>GrCrUrGrCrCrArCrArArUrCrCrCrUrCrGrGrCrCrCrUrU*mC*m<br>U*mC | 30916 |
| RNACS 4986 | hPKU5 R20 P8 sub3 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrUr<br>GrCrUrGrCrCrArCrArArUrCrCrCrGrCrGrGrCrCrCrUrU*mC*m<br>U*mC | 30917 |
| RNACS 4987 | hPKU5 R20 P8 sub4 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrUr<br>GrCrUrGrCrCrArCrArArUrArCrCrUrCrGrCrCrCrCrUrU*mC*m<br>U*mC | 30918 |
| RNACS 4988 | hPKU5 R20 P8 sub7 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrUr<br>GrCrUrGrCrCrArCrGrArUrArCrCrUrCrGrGrCrCrCrUrU*mC*m<br>U*mC | 30919 |
| RNACS 4989 | hPKU5 R18 P8 sub0 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrUrCrGrGrCrCrCrUrU*mC*mU*mC | 30920 |
| RNACS 4990 | hPKU5 R18 P8 sub1 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrGrCrGrGrCrCrCrUrU*mC*mU*mC | 30921 |
| RNACS 4991 | hPKU5 R18 P8 sub2 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrCrCrCrUrCrGrGrCrCrCrUrU*mC*mU*mC | 30922 |
| RNACS 4992 | hPKU5 R18 P8 sub3 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrCrCrCrGrCrGrGrCrCrCrUrU*mC*mU*mC | 30923 |
| RNACS 4993 | hPKU5 R18 P8 sub4 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrArArUrArCrCrUrCrGrCrCrCrCrUrU*mC*mU*mC | 30924 |
| RNACS 4994 | hPKU5 R18 P8 sub7 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrCr<br>UrGrCrCrArCrGrArUrArCrCrUrCrGrGrCrCrCrUrU*mC*mU*mC | 30925 |
| RNACS 4995 | hPKU5 R16 P8 sub0 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrUrCrGrGrCrCrCrUrU*mC*mU*mC | 30926 |
| RNACS 4996 | hPKU5 R16 P8 sub1 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrGrCrGrGrCrCrCrUrU*mC*mU*mC | 30927 |

TABLE E6-continued

Exemplary Template RNAs with Various Silent Substitutions

| RNACS# | Name | IDT Notation | SEQ ID NO |
|---|---|---|---|
| RNACS 4997 | hPKU5 R16 P8 sub2 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrCrCrCrUrCrGrGrCrCrCrUrU*mC*mU*mC | 30928 |
| RNACS 4998 | hPKU5 R16 P8 sub3 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrCrCrCrGrCrGrGrCrCrCrUrU*mC*mU*mC | 30929 |
| RNACS 4999 | hPKU5 R16 P8 sub4 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrArArUrArCrCrUrCrGrCrCrCrCrUrU*mC*mU*mC | 30930 |
| RNACS 5000 | hPKU5 R16 P8 sub7 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrUrGr<br>CrCrArCrGrArUrArCrCrUrCrGrGrCrCrCrUrUmC*mU*mC | 30931 |
| RNACS 5001 | hPKU5 R14 P8 sub0 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrUrCrGrGrCrCrCrUrU*mC*mU*mC | 30932 |
| RNACS 5002 | hPKU5 R14 P8 sub1 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrGrCrGrGrCrCrCrUrU*mC*mU*mC | 30933 |
| RNACS 5003 | hPKU5 R14 P8 sub2 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrCrCrCrUrCrGrGrCrCrCrUrUmC*mU*mC | 30934 |
| RNACS 5004 | hPKU5 R14 P8 sub3 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrCrCrCrGrCrGrGrCrCrCrUrU*mC*mU*mC | 30935 |
| RNACS 5005 | hPKU5 R14 P8 sub4 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrArArUrArCrCrUrCrGrCrCrCrCrUrU*mC*mU*mC | 30936 |
| RNACS 5006 | hPKU5 R14 P8 sub7 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrCr<br>ArCrGrArUrArCrCrUrCrGrGrCrCrCrUrU*mC*mU*mC | 30937 |
| RNACS 5007 | hPKU5 R12 P8 sub0 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrUrCrGrGrCrCrCrUrU*mC*mU*mC | 30938 |
| RNACS 5008 | hPKU5 R12 P8 sub1 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrArCr<br>ArArUrArCrCrGrCrGrGrCrCrCrUrU*mC*mU*mC | 30939 |
| RNACS 5009 | hPKU5 R12 P8 | mU*mA*mG*rCrGrArArCrUrGrArGrArArGrGrGrCrCrArGrUrUr<br>UrUrArGrAmGmCmUmAmGmAmAmAmUmAmGmCrArArGrUrUrArArAr | 30940 |

TABLE E6-continued

Exemplary Template RNAs with Various Silent Substitutions

| RNACS# | Name | IDT Notation | SEQ ID NO |
|---|---|---|---|
| | sub2 | ArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrUrCrGrGrCrCrCrUrU*mC*mU*mC | |
| RNACS 5010 | hPKU5 R12 P8 sub3 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrCrCrCrGrCrGrGrCrCrCrUrU*mC*mU*mC | 30941 |
| RNACS 5011 | hPKU5 R12 P8 sub4 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrArArUrArCrCrUrCrGrCrCrCrCrUrU*mC*mU*mC | 30942 |
| RNACS 5012 | hPKU5 R12 P8 sub7 | mU*mA*mG*rCrGrArArCrUrGrArGrArArGrGrGrCrCrArGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArCrGrArUrArCrCrUrCrGrGrCrCrCrUrU*mC*mU*mC | 30943 |
| RNACS 5013 | hPKU6 R20 P11 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrCrCrGrArGrGrUrArUrUrGrUrGrG*mC*mA*mG | 30944 |
| RNACS 5014 | hPKU6 R20 P11 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrCrCrGrGrGrGrUrArUrUrGrUrGrG*mC*mA*mG | 30945 |
| RNACS 5015 | hPKU6 R20 P11 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArCrGrGrCrCrGrGrGrGrUrArUrUrGrUrGrG*mC*mA*mG | 30946 |
| RNACS 5016 | hPKU6 R20 P11 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArCrGrGrArCrGrGrGrGrUrArUrUrGrUrGrG*mC*mA*mG | 30947 |
| RNACS 5017 | hPKU6 R20 P11 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrCrCrGrCrGrGrUrArUrUrGrUrGrG*mC*mA*mG | 30948 |
| RNACS 5018 | hPKU6 R20 P11 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrArCrGrCrGrGrUrArUrUrGrUrGrG*mC*mA*mG | 30949 |
| RNACS 5019 | hPKU6 R18 P11 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrCrCrGrArGrGrUrArUrUrGrUrGrG*mC*mA*mG | 30950 |

TABLE E6-continued

Exemplary Template RNAs with Various Silent Substitutions

| RNACS# | Name | IDT Notation | SEQ ID NO |
|---|---|---|---|
| RNACS 5020 | hPKU6 R18 P11 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrCrCrGrGrGrGrUrArUrUrGrUrGrG*mC*mA*mG | 30951 |
| RNACS 5021 | hPKU6 R18 P11 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArCrGrGrCrCrGrGrGrGrUrArUrUrGrUrGrG*mC*mA*mG | 30952 |
| RNACS 5022 | hPKU6 R18 P11 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArCrGrGrArCrGrGrGrGrUrArUrUrGrUrGrG*mC*mA*mG | 30953 |
| RNACS 5023 | hPKU6 R18 P11 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrCrCrGrCrGrGrUrArUrUrGrUrGrG*mC*mA*mG | 30954 |
| RNACS 5024 | hPKU6 R18 P11 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrArCrGrCrGrGrUrArUrUrGrUrGrG*mC*mA*mG | 30955 |
| RNACS 5025 | hPKU6 R16 P11 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrCrCrGrArGrGrUrArUrUrGrUrGrG*mC*mA*mG | 30956 |
| RNACS 5026 | hPKU6 R16 P11 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrCrCrGrGrGrGrUrArUrUrGrUrGrG*mC*mA*mG | 30957 |
| RNACS 5027 | hPKU6 R16 P11 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArCrGrGrCrCrGrGrGrGrUrArUrUrGrUrGrG*mC*mA*mG | 30958 |
| RNACS 5028 | hPKU6 R16 P11 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArCrGrGrArCrGrGrGrGrUrArUrUrGrUrGrG*mC*mA*mG | 30959 |
| RNACS 5029 | hPKU6 R16 P11 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrCrCrGrCrGrGrUrArUrUrGrUrGrG*mC*mA*mG | 30960 |

TABLE E6-continued

| Exemplary Template RNAs with Various Silent Substitutions | | | |
|---|---|---|---|
| RNACS# | Name | IDT Notation | SEQ ID NO |
| RNACS 5030 | hPKU6 R16 P11 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrArCrGrCrGrGrUrArUrUrGrUrGrG*mC*mA*mG | 30961 |
| RNACS 5031 | hPKU6 R14 P11 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArGrGrGrCrCrGrArGrGrUrArUrUrGrUrGrG*mC*mA*mG | 30962 |
| RNACS 5032 | hPKU6 R14 P11 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArGrGrGrCrCrGrGrGrGrUrArUrUrGrUrGrG*mC*mA*mG | 30963 |
| RNACS 5033 | hPKU6 R14 P11 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArCrGrGrCrCrGrGrGrGrUrArUrUrGrUrGrG*mC*mA*mG | 30964 |
| RNACS 5034 | hPKU6 R14 P11 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArCrGrGrArCrGrGrGrGrUrArUrUrGrUrGrG*mC*mA*mG | 30965 |
| RNACS 5035 | hPKU6 R14 P11 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArGrGrGrCrCrGrCrGrGrUrArUrUrGrUrGrG*mC*mA*mG | 30966 |
| RNACS 5036 | hPKU6 R14 P11 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArGrGrGrArCrGrCrGrGrUrArUrUrGrUrGrG*mC*mA*mG | 30967 |
| RNACS 5037 | hPKU6 R12 P11 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArArGrGrGrCrCrGrArGrGrUrArUrUrGrUrGrG*mC*mA*mG | 30968 |
| RNACS 5038 | hPKU6 R12 P11 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArArGrGrGrCrCrGrGrGrGrUrArUrUrGrUrGrG*mC*mA*mG | 30969 |
| RNACS 5039 | hPKU6 R12 P11 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArArCrGrGrCrCrGrGrGrGrUrArUrUrGrUrGrG*mC*mA*mG | 30970 |
| RNACS 5040 | hPKU6 R12 P11 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArArCrGrGrArCrGrGrGrGrUrArUrUrGrUrGrG*mC*mA*mG | 30971 |
| RNACS 5041 | hPKU6 R12 P11 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArArGrGrGrCrCrGrCrGrGrUrArUrUrGrUrGrG*mC*mA*mG | 30972 |
| RNACS 5042 | hPKU6 R12 P11 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArAr | 30973 |

TABLE E6-continued

Exemplary Template RNAs with Various Silent Substitutions

| RNACS# | Name | IDT Notation | SEQ ID NO |
|---|---|---|---|
| | sub7 | ArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArArGrGrGrArCrGrCrGrGrUrArUrUrGrUrGrG*mC*mA*mG | |
| RNACS 5043 | hPKU6 R20 P10 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrCrCrGrArGrGrUrArUrUrGrUrG*mG*mC*mA | 30974 |
| RNACS 5044 | hPKU6 R20 P10 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrCrCrGrGrGrGrUrArUrUrGrUrG*mG*mC*mA | 30975 |
| RNACS 5045 | hPKU6 R20 P10 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArCrGrGrCrCrGrGrGrGrUrArUrUrGrUrG*mG*mC*mA | 30976 |
| RNACS 5046 | hPKU6 R20 P10 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArCrGrGrArCrGrGrGrGrUrArUrUrGrUrG*mG*mC*mA | 30977 |
| RNACS 5047 | hPKU6 R20 P10 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrCrCrGrCrGrGrUrArUrUrGrUrG*mG*mC*mA | 30978 |
| RNACS 5048 | hPKU6 R20 P10 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrArCrGrCrGrGrUrArUrUrGrUrG*mG*mC*mA | 30979 |
| RNACS 5049 | hPKU6 R18 P10 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrCrCrGrArGrGrUrArUrUrGrUrG*mG*mC*mA | 30980 |
| RNACS 5050 | hPKU6 R18 P10 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrCrCrGrGrGrGrUrArUrUrGrUrG*mG*mC*mA | 30981 |
| RNACS 5051 | hPKU6 R18 P10 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArCrGrGrCrCrGrGrGrGrUrArUrUrGrUrG*mG*mC*mA | 30982 |
| RNACS 5052 | hPKU6 R18 P10 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArCrGrGrArCrGrGrGrGrUrArUrUrGrUrG*mG*mC*mA | 30983 |

TABLE E6-continued

Exemplary Template RNAs with Various Silent Substitutions

| RNACS# | Name | IDT Notation | SEQ ID NO |
|---|---|---|---|
| RNACS 5053 | hPKU6 R18 P10 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrCrCrGrCrGrGrUrArUrUrGrUrG*mG*mC*mA | 30984 |
| RNACS 5054 | hPKU6 R18 P10 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrArCrGrCrGrGrUrArUrUrGrUrG*mG*mC*mA | 30985 |
| RNACS 5055 | hPKU6 R16 P10 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrCrCrGrArGrGrUrArUrUrGrUrG*mG*mC*mA | 30986 |
| RNACS 5056 | hPKU6 R16 P10 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrCrCrGrGrGrGrUrArUrUrGrUrG*mG*mC*mA | 30987 |
| RNACS 5057 | hPKU6 R16 P10 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArCrGrGrCrCrGrGrGrGrUrArUrUrGrUrG*mG*mC*mA | 30988 |
| RNACS 5058 | hPKU6 R16 P10 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArCrGrGrArCrGrGrGrGrUrArUrUrGrUrG*mG*mC*mA | 30989 |
| RNACS 5059 | hPKU6 R16 P10 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrCrCrGrCrGrGrUrArUrUrGrUrG*mG*mC*mA | 30990 |
| RNACS 5060 | hPKU6 R16 P10 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrArCrGrCrGrGrUrArUrUrGrUrG*mG*mC*mA | 30991 |
| RNACS 5061 | hPKU6 R14 P10 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArGrGrGrCrCrGrArGrGrUrArUrUrGrUrG*mG*mC*mA | 30992 |
| RNACS 5062 | hPKU6 R14 P10 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArGrGrGrCrCrGrGrGrGrUrArUrUrGrUrG*mG*mC*mA | 30993 |
| RNACS 5063 | hPKU6 R14 P10 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArCrGrGrCrCrGrGrGrGrUrArUrUrGrUrG*mG*mC*mA | 30994 |
| RNACS 5064 | hPKU6 R14 P10 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArGrArArCrGrGrArCrGrGrGrGrUrArUrUrGrUrG*mG*mC*mA | 30995 |

TABLE E6-continued

Exemplary Template RNAs with Various Silent Substitutions

| RNACS# | Name | IDT Notation | SEQ ID NO |
|---|---|---|---|
| RNACS 5065 | hPKU6 R14 P10 sub6 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>GrArArGrGrGrCrCrGrCrGrGrUrArUrUrGrUrG*mG*mC*mA | 30996 |
| RNACS 5066 | hPKU6 R14 P10 sub7 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>GrArArGrGrGrArCrGrCrGrGrUrArUrUrGrUrG*mG*mC*mA | 30997 |
| RNACS 5067 | hPKU6 R12 P10 sub0 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>ArGrGrGrCrCrGrArGrGrUrArUrUrGrUrG*mG*mC*mA | 30998 |
| RNACS 5068 | hPKU6 R12 P10 sub1 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>ArGrGrGrCrCrGrGrGrGrUrArUrUrGrUrG*mG*mC*mA | 30999 |
| RNACS 5069 | hPKU6 R12 P10 sub4 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>ArCrGrGrCrCrGrGrGrGrUrArUrUrGrUrG*mG*mC*mA | 31000 |
| RNACS 5070 | hPKU6 R12 P10 sub5 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>ArCrGrGrArCrGrGrGrGrUrArUrUrGrUrG*mG*mC*mA | 31001 |
| RNACS 5071 | hPKU6 R12 P10 sub6 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>ArGrGrGrCrCrGrCrGrGrUrArUrUrGrUrG*mG*mC*mA | 31002 |
| RNACS 5072 | hPKU6 R12 P10 sub7 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>ArGrGrGrArCrGrCrGrGrUrArUrUrGrUrG*mG*mC*mA | 31003 |
| RNACS 5073 | hPKU6 R20 P9 sub0 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrGr<br>ArArCrUrGrArGrArArGrGrGrCrCrGrArGrGrUrArUrUrGrU*mG<br>*mG*mC | 31004 |
| RNACS 5074 | hPKU6 R20 P9 sub1 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrGr<br>ArArCrUrGrArGrArArGrGrGrCrCrGrGrGrGrUrArUrUrGrU*mG<br>*mG*mC | 31005 |
| RNACS 5075 | hPKU6 R20 P9 sub4 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrGr<br>ArArCrUrGrArGrArArCrGrGrCrCrGrGrGrGrUrArUrUrGrU*mG<br>*mG*mC | 31006 |
| RNACS 5076 | hPKU6 R20 P9 sub5 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrGr<br>ArArCrUrGrArGrArArCrGrGrArCrGrGrGrGrUrArUrUrGrU*mG<br>*mG*mC | 31007 |

TABLE E6-continued

Exemplary Template RNAs with Various Silent Substitutions

| RNACS# | Name | IDT Notation | SEQ ID NO |
|---|---|---|---|
| RNACS 5077 | hPKU6 R20 P9 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrCrCrGrCrGrGrUrArUrUrGrU*mG*mG*mC | 31008 |
| RNACS 5078 | hPKU6 R20 P9 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrGrArArCrUrGrArGrArArGrGrGrArCrGrCrGrGrUrArUrUrGrU*mG*mG*mC | 31009 |
| RNACS 5079 | hPKU6 R18 P9 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrCrCrGrArGrGrUrArUrUrGrU*mG*mG*mC | 31010 |
| RNACS 5080 | hPKU6 R18 P9 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrCrCrGrGrGrGrUrArUrUrGrU*mG*mG*mC | 31011 |
| RNACS 5081 | hPKU6 R18 P9 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArCrGrGrCrCrGrGrGrGrUrArUrUrGrU*mG*mG*mC | 31012 |
| RNACS 5082 | hPKU6 R18 P9 sub5 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArCrGrGrArCrGrGrGrGrUrArUrUrGrU*mG*mG*mC | 31013 |
| RNACS 5083 | hPKU6 R18 P9 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrCrCrGrCrGrGrUrArUrUrGrU*mG*mG*mC | 31014 |
| RNACS 5084 | hPKU6 R18 P9 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrArArCrUrGrArGrArArGrGrGrArCrGrCrGrGrUrArUrUrGrU*mG*mG*mC | 31015 |
| RNACS 5085 | hPKU6 R16 P9 sub0 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrCrCrGrArGrGrUrArUrUrGrU*mG*mG*mC | 31016 |
| RNACS 5086 | hPKU6 R16 P9 sub1 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArGrGrGrCrCrGrGrGrGrUrArUrUrGrU*mG*mG*mC | 31017 |
| RNACS 5087 | hPKU6 R16 P9 sub4 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrCrUrGrArGrArArCrGrGrCrCrGrGrGrGrUrArUrUrGrU*mG*mG*mC | 31018 |

TABLE E6-continued

Exemplary Template RNAs with Various Silent Substitutions

| RNACS# | Name | IDT Notation | SEQ ID NO |
|---|---|---|---|
| RNACS 5088 | hPKU6 R16 P9 sub5 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrUr<br>GrArGrArArCrGrGrArCrGrGrGrGrUrArUrUrGrU*mG*mG*mC | 31019 |
| RNACS 5089 | hPKU6 R16 P9 sub6 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrUr<br>GrArGrArArGrGrGrCrCrGrCrGrGrUrArUrUrGrU*mG*mG*mC | 31020 |
| RNACS 5090 | hPKU6 R16 P9 sub7 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrCrUr<br>GrArGrArArGrGrGrArCrGrCrGrGrUrArUrUrGrU*mG*mG*mC | 31021 |
| RNACS 5091 | hPKU6 R14 P9 sub0 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>GrArArGrGrGrCrCrGrArGrGrUrArUrUrGrU*mG*mG*mC | 31022 |
| RNACS 5092 | hPKU6 R14 P9 sub1 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>GrArArGrGrGrCrCrGrGrGrGrUrArUrUrGrU*mG*mG*mC | 31023 |
| RNACS 5093 | hPKU6 R14 P9 sub4 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>GrArArCrGrGrCrCrGrGrGrGrUrArUrUrGrU*mG*mG*mC | 31024 |
| RNACS 5094 | hPKU6 R14 P9 sub5 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>GrArArCrGrGrArCrGrGrGrGrUrArUrUrGrU*mG*mG*mC | 31025 |
| RNACS 5095 | hPKU6 R14 P9 sub6 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>GrArArGrGrGrCrCrGrCrGrGrUrArUrUrGrU*mG*mG*mC | 31026 |
| RNACS 5096 | hPKU6 R14 P9 sub7 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>GrArArGrGrGrArCrGrCrGrGrUrArUrUrGrU*mG*mG*mC | 31027 |
| RNACS 5097 | hPKU6 R12 P9 sub0 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>ArGrGrGrCrCrGrArGrGrUrArUrUrGrU*mG*mG*mC | 31028 |
| RNACS 5098 | hPKU6 R12 P9 sub1 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>ArGrGrGrCrCrGrGrGrGrUrArUrUrGrU*mG*mG*mC | 31029 |
| RNACS 5099 | hPKU6 R12 P9 sub4 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm<br>AmAmAmAmAmGmUmGmGmCmAmCmCmGmAmGmUmCmGmGmUmGmCrGrAr<br>ArCrGrGrCrCrGrGrGrGrUrArUrUrGrU*mG*mG*mC | 31030 |
| RNACS 5100 | hPKU6 R12 P9 sub5 | mA*mC*mU*rUrUrGrCrUrGrCrCrArCrArArUrArCrCrUrGrUrUr<br>UrUrArGrAmGmCmUmAmGmAmAmAmUmAmGmCrArArGrUrUrArArAr<br>ArUrArArGrGrCrUrArGrUrCrCrGrUrUrArUrCrAmAmCmUmUmGm | 31031 |

TABLE E6-continued

| Exemplary Template RNAs with Various Silent Substitutions | | | |
|---|---|---|---|
| RNACS# | Name | IDT Notation | SEQ ID NO |
| | | AmAmAmAmAmGmUmGmGmCmAmCmCmGmAmGmUmCmGmGmUmGmCrGrArArCrGrGrArCrGrGrGrGrUrArUrUrGrU*mG*mG*mC | |
| RNACS 5101 | hPKU6 R12 P9 sub6 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArArGrGrGrCrCrGrCrGrGrUrArUrUrGrU*mG*mG*mC | 31032 |
| RNACS 5102 | hPKU6 R12 P9 sub7 | mA*mC*mU*rUrUrGrCrUrGrCrCrArCrArArUrArCrCrUrGrUrUrUrUrArGrAmGmCmUmAmGmAmAmAmUmAmGmCrArArGrUrUrArArArArUrArArGrGrCrUrArGrUrCrCrGrUrUrArUrCrAmAmCmUmUmGmAmAmAmAmAmGmUmGmGmCmAmCmCmGmAmGmUmCmGmGmUmGmCrGrArArGrGrGrArCrGrCrGrGrUrArUrUrGrU*mG*mG*mC | 31033 |

Table E6A shows the sequences of E6 without chemical modifications. In some embodiments, the sequences of Table E6A may be used without chemical modifications, or with one or more chemical modifications.

TABLE E6A

| Table E6 Sequences without Chemical Modifications | | | |
|---|---|---|---|
| RNACS# | Name | IDT Notation | SEQ ID NO |
| RNACS4 741 | hPKU3 R25 P10 sub0 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCGCUGCCACAAUACCUCGGCCCUUCUCAGUUCGCUA | 37267 |
| RNACS4 742 | hPKU3 R25 P10 sub1 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCGCUGCCACAAUACCGCGGCCCUUCUCAGUUCGCUA | 37268 |
| RNACS4 743 | hPKU3 R25 P10 sub2 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCGCUGCCACAAUCCCUCGGCCCUUCUCAGUUCGCUA | 37269 |
| RNACS4 744 | hPKU3 R25 P10 sub4 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCGCUGCCACAAUACCUCGCCCCUUCUCAGUUCGCUA | 37270 |
| RNACS4 745 | hPKU3 R25 P10 sub7 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCGCUGCCACAAUACCGCGCCCCUUCUCAGUUCGCUA | 37271 |
| RNACS4 746 | hPKU3 R25 P10 sub8 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCGCUGCCACAAUACCGCGCCCAUUCUCAGUUCGCUA | 37272 |
| RNACS4 747 | hPKU3 R23 P10 sub0 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCUGCCACAAUACCUCGGCCCUUCUCAGUUCGCUA | 37273 |
| RNACS4 748 | hPKU3 R23 P10 sub1 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCUGCCACAAUACCGCGGCCCUUCUCAGUUCGCUA | 37274 |
| RNACS4 749 | hPKU3 R23 P10 sub2 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCUGCCACAAUCCCUCGGCCCUUCUCAGUUCGCUA | 37275 |
| RNACS4 750 | hPKU3 R23 P10 sub4 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCUGCCACAAUACCUCGCCCCUUCUCAGUUCGCUA | 37276 |
| RNACS4 751 | hPKU3 R23 P10 sub7 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCUGCCACAAUACCGCGCCCCUUCUCAGUUCGCUA | 37277 |
| RNACS4 752 | hPKU3 R23 P10 sub8 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCUGCCACAAUACCGCGCCCAUUCUCAGUUCGCUA | 37278 |
| RNACS4 753 | hPKU3 R21 P10 sub0 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCCCACAAUACCUCGGCCCUUCUCAGUUCGCUA | 37279 |
| RNACS4 754 | hPKU3 R21 P10 sub1 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCCCACAAUACCGCGGCCCUUCUCAGUUCGCUA | 37280 |
| RNACS4 755 | hPKU3 R21 P10 sub2 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCCCACAAUCCCUCGGCCCUUCUCAGUUCGCUA | 37281 |
| RNACS4 756 | hPKU3 R21 P10 sub4 | UGGGUCGUAGCGAACUGAGAGUUUUAGAGCUAGAAAUAGCAAGUUAAAAUAAGGCUAGUCCGUUAUCAACUUGAAAAAGUGGCACCGAGUCGGUGCCCACAAUACCUCGCCCCUUCUCAGUUCGCUA | 37282 |

TABLE E6A-continued

| Table E6 Sequences without Chemical Modifications | | | |
|---|---|---|---|
| RNACS# | Name | IDT Notation | SEQ ID NO |
| RNACS4 757 | hPKU3 R21 P10 sub7 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCCCACAAUACCGCGCCCCUUCUCAGUUCGCUA | 37283 |
| RNACS4 758 | hPKU3 R21 P10 sub8 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCCCACAAUACCGCGCCCAUUCUCAGUUCGCUA | 37284 |
| RNACS4 759 | hPKU3 R19 P10 sub0 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCUCGGCCCUUCUCAGUUCGCUA | 37285 |
| RNACS4 760 | hPKU3 R19 P10 sub1 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCGCGGCCCUUCUCAGUUCGCUA | 37286 |
| RNACS4 761 | hPKU3 R19 P10 sub2 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUCCCUCGGCCCUUCUCAGUUCGCUA | 37287 |
| RNACS4 762 | hPKU3 R19 P10 sub4 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCUCGCCCCUUCUCAGUUCGCUA | 37288 |
| RNACS4 763 | hPKU3 R19 P10 sub7 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCGCGCCCCUUCUCAGUUCGCUA | 37289 |
| RNACS4 764 | hPKU3 R19 P10 sub8 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCGCGCCCAUUCUCAGUUCGCUA | 37290 |
| RNACS4 765 | hPKU3 R17 P10 sub0 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCUCGGCCCUUCUCAGUUCGCUA | 37291 |
| RNACS4 766 | hPKU3 R17 P10 sub1 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCGCGGCCCUUCUCAGUUCGCUA | 37292 |
| RNACS4 767 | hPKU3 R17 P10 sub2 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUCCCUCGGCCCUUCUCAGUUCGCUA | 37293 |
| RNACS4 768 | hPKU3 R17 P10 sub4 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCUCGCCCCUUCUCAGUUCGCUA | 37294 |
| RNACS4 769 | hPKU3 R17 P10 sub7 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCGCGCCCCUUCUCAGUUCGCUA | 37295 |
| RNACS4 770 | hPKU3 R17 P10 sub8 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCGCGCCCAUUCUCAGUUCGCUA | 37296 |
| RNACS4 771 | hPKU3 R25 P9 sub0 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGGCCCUUCUCAGUUCGCU | 37297 |
| RNACS4 772 | hPKU3 R25 P9 sub1 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGGCCCUUCUCAGUUCGCU | 37298 |
| RNACS4 773 | hPKU3 R25 P9 sub2 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUCCCUCGGCCCUUCUCAGUUCGCU | 37299 |
| RNACS4 774 | hPKU3 R25 P9 sub4 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGCCCCUUCUCAGUUCGCU | 37300 |
| RNACS4 775 | hPKU3 R25 P9 sub7 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGCCCCUUCUCAGUUCGCU | 37301 |
| RNACS4 776 | hPKU3 R25 P9 sub8 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGCCCAUUCUCAGUUCGCU | 37302 |
| RNACS4 777 | hPKU3 R23 P9 sub0 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCUGCCACAAUACCUCGGCCCUUCUCAGUUCGCU | 37303 |
| RNACS4 778 | hPKU3 R23 P9 sub1 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCUGCCACAAUACCGCGGCCCUUCUCAGUUCGCU | 37304 |
| RNACS4 779 | hPKU3 R23 P9 sub2 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCUGCCACAAUCCCUCGGCCCUUCUCAGUUCGCU | 37305 |
| RNACS4 780 | hPKU3 R23 P9 sub4 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCUGCCACAAUACCUCGCCCCUUCUCAGUUCGCU | 37306 |
| RNACS4 781 | hPKU3 R23 P9 sub7 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCUGCCACAAUACCGCGCCCCUUCUCAGUUCGCU | 37307 |

TABLE E6A-continued

| Table E6 Sequences without Chemical Modifications | | | |
|---|---|---|---|
| RNACS# | Name | IDT Notation | SEQ ID NO |
| RNACS4 782 | hPKU3 R23 P9 sub8 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCUGCCACAAUACCGCGCCCAUUCUCAGUUCGCU | 37308 |
| RNACS4 783 | hPKU3 R21 P9 sub0 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCCCACAAUACCUCGGCCCUUCUCAGUUCGCU | 37309 |
| RNACS4 784 | hPKU3 R21 P9 sub1 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCCCACAAUACCGCGGCCCUUCUCAGUUCGCU | 37310 |
| RNACS4 785 | hPKU3 R21 P9 sub2 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCCCACAAUCCCUCGGCCCUUCUCAGUUCGCU | 37311 |
| RNACS4 786 | hPKU3 R21 P9 sub4 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCCCACAAUACCUCGCCCCUUCUCAGUUCGCU | 37312 |
| RNACS4 787 | hPKU3 R21 P9 sub7 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCCCACAAUACCGCGCCCCUUCUCAGUUCGCU | 37313 |
| RNACS4 788 | hPKU3 R21 P9 sub8 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCCCACAAUACCGCGCCCAUUCUCAGUUCGCU | 37314 |
| RNACS4 789 | hPKU3 R19 P9 sub0 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCUCGGCCCUUCUCAGUUCGCU | 37315 |
| RNACS4 790 | hPKU3 R19 P9_sub1 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCGCGGCCCUUCUCAGUUCGCU | 37316 |
| RNACS4 791 | hPKU3 R19 P9 sub2 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUCCCUCGGCCCUUCUCAGUUCGCU | 37317 |
| RNACS4 792 | hPKU3 R19 P9 sub4 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCUCGCCCCUUCUCAGUUCGCU | 37318 |
| RNACS4 793 | hPKU3 R19 P9 sub7 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCGCGCCCCUUCUCAGUUCGCU | 37319 |
| RNACS4 794 | hPKU3 R19 P9 sub8 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCACAAUACCGCGCCCAUUCUCAGUUCGCU | 37320 |
| RNACS4 795 | hPKU3 R17 P9 sub0 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCUCGGCCCUUCUCAGUUCGCU | 37321 |
| RNACS4 796 | hPKU3 R17 P9 sub1 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCGCGGCCCUUCUCAGUUCGCU | 37322 |
| RNACS4 797 | hPKU3 R17 P9 sub2 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUCCCUCGGCCCUUCUCAGUUCGCU | 37323 |
| RNACS4 798 | hPKU3 R17 P9 sub4 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCUCGCCCCUUCUCAGUUCGCU | 37324 |
| RNACS4 799 | hPKU3 R17 P9 sub7 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCGCGCCCCUUCUCAGUUCGCU | 37325 |
| RNACS4 800 | hPKU3 R17 P9 sub8 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCAAUACCGCGCCCAUUCUCAGUUCGCU | 37326 |
| RNACS4 801 | hPKU3 R25 P8 sub0 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGGCCCUUCUCAGUUCGC | 37327 |
| RNACS4 802 | hPKU3 R25 P8 sub1 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGGCCCUUCUCAGUUCGC | 37328 |
| RNACS4 803 | hPKU3 R25 P8 sub2 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUCCCUCGGCCCUUCUCAGUUCGC | 37329 |
| RNACS4 804 | hPKU3 R25 P8 sub4 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGCCCCUUCUCAGUUCGC | 37330 |
| RNACS4 805 | hPKU3 R25 P8 sub7 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGCCCCUUCUCAGUUCGC | 37331 |
| RNACS4 806 | hPKU3 R25 P8 sub8 | UGGGUCGUAGCGAACUGAGAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGCCCAUUCUCAGUUCGC | 37332 |

TABLE E6A-continued

| Table E6 Sequences without Chemical Modifications | | | |
|---|---|---|---|
| RNACS# | Name | IDT Notation | SEQ ID NO |
| RNACS4<br>807 | hPKU3 R23<br>P8 sub0 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCUGCCACAAUACCUCGGCCCUUCUCAGUUCGC | 37333 |
| RNACS4<br>808 | hPKU3 R23<br>P8 sub1 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCUGCCACAAUACCGCGGCCCUUCUCAGUUCGC | 37334 |
| RNACS4<br>809 | hPKU3 R23<br>P8 sub2 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCUGCCACAAUCCCUCGGCCCUUCUCAGUUCGC | 37335 |
| RNACS4<br>810 | hPKU3 R23<br>P8 sub4 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCUGCCACAAUACCUCGCCCCUUCUCAGUUCGC | 37336 |
| RNACS4<br>811 | hPKU3 R23<br>P8 sub7 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCUGCCACAAUACCGCGCCCCUUCUCAGUUCGC | 37337 |
| RNACS4<br>812 | hPKU3 R23<br>P8 sub8 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCUGCCACAAUACCGCGCCCAUUCUCAGUUCGC | 37338 |
| RNACS4<br>813 | hPKU3 R21<br>P8 sub0 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCCCACAAUACCUCGGCCCUUCUCAGUUCGC | 37339 |
| RNACS4<br>814 | hPKU3 R21<br>P8 sub1 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCCCACAAUACCGCGGCCCUUCUCAGUUCGC | 37340 |
| RNACS4<br>815 | hPKU3 R21<br>P8 sub2 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCCCACAAUCCCUCGGCCCUUCUCAGUUCGC | 37341 |
| RNACS4<br>816 | hPKU3 R21<br>P8 sub4 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCCCACAAUACCUCGCCCCUUCUCAGUUCGC | 37342 |
| RNACS4<br>817 | hPKU3 R21<br>P8 sub7 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCCCACAAUACCGCGCCCCUUCUCAGUUCGC | 37343 |
| RNACS4<br>818 | hPKU3 R21<br>P8 sub8 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCCCACAAUACCGCGCCCAUUCUCAGUUCGC | 37344 |
| RNACS4<br>819 | hPKU3 R19<br>P8 sub0 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCACAAUACCUCGGCCCUUCUCAGUUCGC | 37345 |
| RNACS4<br>820 | hPKU3 R19<br>P8 sub1 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCACAAUACCGCGGCCCUUCUCAGUUCGC | 37346 |
| RNACS4<br>821 | hPKU3 R19<br>P8 sub2 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCACAAUCCCUCGGCCCUUCUCAGUUCGC | 37347 |
| RNACS4<br>822 | hPKU3 R19<br>P8 sub4 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCACAAUACCUCGCCCCUUCUCAGUUCGC | 37348 |
| RNACS4<br>823 | hPKU3 R19<br>P8 sub7 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCACAAUACCGCGCCCCUUCUCAGUUCGC | 37349 |
| RNACS4<br>824 | hPKU3 R19<br>P8 sub8 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCACAAUACCGCGCCCAUUCUCAGUUCGC | 37350 |
| RNACS4<br>825 | hPKU3 R17<br>P8 sub0 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCAAUACCUCGGCCCUUCUCAGUUCGC | 37351 |
| RNACS4<br>826 | hPKU3 R17<br>P8 sub1 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCAAUACCGCGGCCCUUCUCAGUUCGC | 37352 |
| RNACS4<br>827 | hPKU3 R17<br>P8 sub2 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCAAUCCCUCGGCCCUUCUCAGUUCGC | 37353 |
| RNACS4<br>828 | hPKU3 R17<br>P8 sub4 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCAAUACCUCGCCCCUUCUCAGUUCGC | 37354 |
| RNACS4<br>829 | hPKU3 R17<br>P8 sub7 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCAAUACCGCGCCCCUUCUCAGUUCGC | 37355 |
| RNACS4<br>830 | hPKU3 R17<br>P8 sub8 | UGGGUCGUAGCGAACUGAGAGUUUUAGAGCUAGAAAUAGCAAGUUAAAAUAAGGCUAGUCCGUUAUCAACUUG<br>AAAAAGUGGCACCGAGUCGGUGCAAUACCGCGCCCAUUCUCAGUUCGC | 37356 |
| RNACS4<br>831 | hPKU4 R24<br>P10 sub0 | GGGUCGUAGCGAACUGAGAAGUUUUAGAGCUAGAAAUAGCAAGUUAAAAUAAGGCUAGUCCGUUAUCAACUUG<br>AAAAAGUGGCACCGAGUCGGUGCGCUGCCACAAUACCUCGGCCCUUCUCAGUUCGCU | 37357 |

TABLE E6A-continued

| Table E6 Sequences without Chemical Modifications | | | |
|---|---|---|---|
| RNACS# | Name | IDT Notation | SEQ ID NO |
| RNACS4 832 | hPKU4 R24 P10 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGGCCCUUCUCAGUUCGCU | 37358 |
| RNACS4 833 | hPKU4 R24 P10 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGCCCCUUCUCAGUUCGCU | 37359 |
| RNACS4 834 | hPKU4 R24 P10 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGCCCAUUCUCAGUUCGCU | 37360 |
| RNACS4 835 | hPKU4 R24 P10 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGCCCCUUCUCAGUUCGCU | 37361 |
| RNACS4 836 | hPKU4 R24 P10 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGCCCAUUCUCAGUUCGCU | 37362 |
| RNACS4 837 | hPKU4 R22 P10 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCUCGGCCCUUCUCAGUUCGCU | 37363 |
| RNACS4 838 | hPKU4 R22 P10 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCGCGGCCCUUCUCAGUUCGCU | 37364 |
| RNACS4 839 | hPKU4 R22 P10 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCUCGCCCCUUCUCAGUUCGCU | 37365 |
| RNACS4 840 | hPKU4 R22 P10 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCUCGCCCAUUCUCAGUUCGCU | 37366 |
| RNACS4 841 | hPKU4 R22 P10 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCGCGCCCCUUCUCAGUUCGCU | 37367 |
| RNACS4 842 | hPKU4 R22 P10 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCGCGCCCAUUCUCAGUUCGCU | 37368 |
| RNACS4 843 | hPKU4 R20 P10 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCUCGGCCCUUCUCAGUUCGCU | 37369 |
| RNACS4 844 | hPKU4 R20 P10 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCGCGGCCCUUCUCAGUUCGCU | 37370 |
| RNACS4 845 | hPKU4 R20 P10 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCUCGCCCCUUCUCAGUUCGCU | 37371 |
| RNACS4 846 | hPKU4 R20 P10 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCUCGCCCAUUCUCAGUUCGCU | 37372 |
| RNACS4 847 | hPKU4 R20 P10 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCGCGCCCCUUCUCAGUUCGCU | 37373 |
| RNACS4 848 | hPKU4 R20 P10 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCGCGCCCAUUCUCAGUUCGCU | 37374 |
| RNACS4 849 | hPKU4 R18 P10 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCUCGGCCCUUCUCAGUUCGCU | 37375 |
| RNACS4 850 | hPKU4 R18 P10 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCGCGGCCCUUCUCAGUUCGCU | 37376 |
| RNACS4 851 | hPKU4 R18 P10 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCUCGCCCCUUCUCAGUUCGCU | 37377 |
| RNACS4 852 | hPKU4 R18 P10 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCUCGCCCAUUCUCAGUUCGCU | 37378 |
| RNACS4 853 | hPKU4 R18 P10 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCGCGCCCCUUCUCAGUUCGCU | 37379 |
| RNACS4 854 | hPKU4 R18 P10 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCGCGCCCAUUCUCAGUUCGCU | 37380 |
| RNACS4 855 | hPKU4 R16 P10 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCUCGGCCCUUCUCAGUUCGCU | 37381 |
| RNACS4 856 | hPKU4 R16 P10 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCGCGGCCCUUCUCAGUUCGCU | 37382 |

TABLE E6A-continued

| Table E6 Sequences without Chemical Modifications | | | |
|---|---|---|---|
| RNACS# | Name | IDT Notation | SEQ ID NO |
| RNACS4857 | hPKU4 R16 P10 sub4 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCAAUACCUCGCCCCUUCUCAGUUCGCU | 37383 |
| RNACS4858 | hPKU4 R16 P10 sub5 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCAAUACCUCGCCCAUUCUCAGUUCGCU | 37384 |
| RNACS4859 | hPKU4 R16 P10 sub7 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCAAUACCGCGCCCCUUCUCAGUUCGCU | 37385 |
| RNACS4860 | hPKU4 R16 P10 sub8 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCAAUACCGCGCCCAUUCUCAGUUCGCU | 37386 |
| RNACS4861 | hPKU4 R24 P9 sub0 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCGCUGCCACAAUACCUCGGCCCUUCUCAGUUCGC | 37387 |
| RNACS4862 | hPKU4 R24 P9 sub1 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCGCUGCCACAAUACCGCGGCCCUUCUCAGUUCGC | 37388 |
| RNACS4863 | hPKU4 R24 P9 sub4 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCGCUGCCACAAUACCUCGCCCCUUCUCAGUUCGC | 37389 |
| RNACS4864 | hPKU4 R24 P9 sub5 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCGCUGCCACAAUACCUCGCCCAUUCUCAGUUCGC | 37390 |
| RNACS4865 | hPKU4 R24 P9 sub7 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCGCUGCCACAAUACCGCGCCCCUUCUCAGUUCGC | 37391 |
| RNACS4866 | hPKU4 R24 P9 sub8 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCGCUGCCACAAUACCGCGCCCAUUCUCAGUUCGC | 37392 |
| RNACS4867 | hPKU4 R22 P9 sub0 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCUGCCACAAUACCUCGGCCCUUCUCAGUUCGC | 37393 |
| RNACS4868 | hPKU4 R22 P9 sub1 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCUGCCACAAUACCGCGGCCCUUCUCAGUUCGC | 37394 |
| RNACS4869 | hPKU4 R22 P9 sub4 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCUGCCACAAUACCUCGCCCCUUCUCAGUUCGC | 37395 |
| RNACS4870 | hPKU4 R22 P9 sub5 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCUGCCACAAUACCUCGCCCAUUCUCAGUUCGC | 37396 |
| RNACS4871 | hPKU4 R22 P9 sub7 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCUGCCACAAUACCGCGCCCCUUCUCAGUUCGC | 37397 |
| RNACS4872 | hPKU4 R22 P9 sub8 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCUGCCACAAUACCGCGCCCAUUCUCAGUUCGC | 37398 |
| RNACS4873 | hPKU4 R20 P9 sub0 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCCCACAAUACCUCGGCCCUUCUCAGUUCGC | 37399 |
| RNACS4874 | hPKU4 R20 P9 sub1 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCCCACAAUACCGCGGCCCUUCUCAGUUCGC | 37400 |
| RNACS4875 | hPKU4 R20 P9 sub4 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCCCACAAUACCUCGCCCCUUCUCAGUUCGC | 37401 |
| RNACS4876 | hPKU4 R20 P9 sub5 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCCCACAAUACCUCGCCCAUUCUCAGUUCGC | 37402 |
| RNACS4877 | hPKU4 R20 P9 sub7 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCCCACAAUACCGCGCCCCUUCUCAGUUCGC | 37403 |
| RNACS4878 | hPKU4 R20 P9 sub8 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCCCACAAUACCGCGCCCAUUCUCAGUUCGC | 37404 |
| RNACS4879 | hPKU4 R18 P9 sub0 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCACAAUACCUCGGCCCUUCUCAGUUCGC | 37405 |
| RNACS4880 | hPKU4 R18 P9 sub1 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCACAAUACCGCGGCCCUUCUCAGUUCGC | 37406 |
| RNACS4881 | hPKU4 R18 P9 sub4 | GGGUCGUAGCGAACUGAGAAGUUUUAGAGCUAGAAAUAGCAAGUUAAAAUAAGGCUAGUCCGUUAUCAACUUGAAAAAGUGGCACCGAGUCGGUGCACAAUACCUCGCCCCUUCUCAGUUCGC | 37407 |

TABLE E6A-continued

Table E6 Sequences without Chemical Modifications

| RNACS# | Name | IDT Notation | SEQ ID NO |
|---|---|---|---|
| RNACS4 882 | hPKU4 R18 P9 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCUCGCCCAUUCUCAGUUCGC | 37408 |
| RNACS4 883 | hPKU4 R18 P9 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCGCGCCCCUUCUCAGUUCGC | 37409 |
| RNACS4 884 | hPKU4 R18 P9 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCGCGCCCAUUCUCAGUUCGC | 37410 |
| RNACS4 885 | hPKU4 R16 P9 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCUCGGCCCUUCUCAGUUCGC | 37411 |
| RNACS4 886 | hPKU4 R16 P9 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCGCGGCCCUUCUCAGUUCGC | 37412 |
| RNACS4 887 | hPKU4 R16 P9 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCUCGCCCCUUCUCAGUUCGC | 37413 |
| RNACS4 888 | hPKU4 R16 P9 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCUCGCCCAUUCUCAGUUCGC | 37414 |
| RNACS4 889 | hPKU4 R16 P9 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCGCGCCCCUUCUCAGUUCGC | 37415 |
| RNACS4 890 | hPKU4 R16 P9 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCGCGCCCAUUCUCAGUUCGC | 37416 |
| RNACS4 891 | hPKU4 R24 P8 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGGCCCUUCUCAGUUCG | 37417 |
| RNACS4 892 | hPKU4 R24 P8 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGGCCCUUCUCAGUUCG | 37418 |
| RNACS4 893 | hPKU4 R24 P8 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGCCCCUUCUCAGUUCG | 37419 |
| RNACS4 894 | hPKU4 R24 P8 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGCCCAUUCUCAGUUCG | 37420 |
| RNACS4 895 | hPKU4 R24 P8 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGCCCCUUCUCAGUUCG | 37421 |
| RNACS4 896 | hPKU4 R24 P8 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGCCCAUUCUCAGUUCG | 37422 |
| RNACS4 897 | hPKU4 R22 P8 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCUCGGCCCUUCUCAGUUCG | 37423 |
| RNACS4 898 | hPKU4 R22 P8 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCGCGGCCCUUCUCAGUUCG | 37424 |
| RNACS4 899 | hPKU4 R22 P8 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCUCGCCCCUUCUCAGUUCG | 37425 |
| RNACS4 900 | hPKU4 R22 P8 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCUCGCCCAUUCUCAGUUCG | 37426 |
| RNACS4 901 | hPKU4 R22 P8 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCGCGCCCCUUCUCAGUUCG | 37427 |
| RNACS4 902 | hPKU4 R22 P8 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCUGCCACAAUACCGCGCCCAUUCUCAGUUCG | 37428 |
| RNACS4 903 | hPKU4 R20 P8 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCUCGGCCCUUCUCAGUUCG | 37429 |
| RNACS4 904 | hPKU4 R20 P8 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCGCGGCCCUUCUCAGUUCG | 37430 |
| RNACS4 905 | hPKU4 R20 P8 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCUCGCCCCUUCUCAGUUCG | 37431 |
| RNACS4 906 | hPKU4 R20 P8 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCUCGCCCAUUCUCAGUUCG | 37432 |

TABLE E6A-continued

Table E6 Sequences without Chemical Modifications

| RNACS# | Name | IDT Notation | SEQ ID NO |
|---|---|---|---|
| RNACS4 907 | hPKU4 R20 P8 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCGCGCCCCUUCUCAGUUCG | 37433 |
| RNACS4 908 | hPKU4 R20 P8 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCCCACAAUACCGCGCCCAUUCUCAGUUCG | 37434 |
| RNACS4 909 | hPKU4 R18 P8 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCUCGGCCCUUCUCAGUUCG | 37435 |
| RNACS4 910 | hPKU4 R18 P8 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCGCGGCCCUUCUCAGUUCG | 37436 |
| RNACS4 911 | hPKU4 R18 P8 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCUCGCCCCUUCUCAGUUCG | 37437 |
| RNACS4 912 | hPKU4 R18 P8 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCUCGCCCAUUCUCAGUUCG | 37438 |
| RNACS4 913 | hPKU4 R18 P8 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCGCGCCCCUUCUCAGUUCG | 37439 |
| RNACS4 914 | hPKU4 R18 P8 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCACAAUACCGCGCCCAUUCUCAGUUCG | 37440 |
| RNACS4 915 | hPKU4 R16 P8 sub0 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCUCGGCCCUUCUCAGUUCG | 37441 |
| RNACS4 916 | hPKU4 R16 P8 sub1 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCGCGGCCCUUCUCAGUUCG | 37442 |
| RNACS4 917 | hPKU4 R16 P8 sub4 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCUCGCCCCUUCUCAGUUCG | 37443 |
| RNACS4 918 | hPKU4 R16 P8 sub5 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCUCGCCCAUUCUCAGUUCG | 37444 |
| RNACS4 919 | hPKU4 R16 P8 sub7 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCGCGCCCCUUCUCAGUUCG | 37445 |
| RNACS4 920 | hPKU4 R16 P8 sub8 | GGGUCGUAGCGAACUGAGAAGUUUUAGAGCUAGAAAUAGCAAGUUAAAAUAAGGCUAGUCCGUUAUCAACUUG AAAAAGUGGCACCGAGUCGGUGCAAUACCGCGCCCAUUCUCAGUUCG | 37446 |
| RNACS4 923 | hPKU5 R20 P10 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUACCUCGGCCCUUCUCAG | 37447 |
| RNACS4 924 | hPKU5 R20 P10 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUACCGCGGCCCUUCUCAG | 37448 |
| RNACS4 925 | hPKU5 R20 P10 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUCCCUCGGCCCUUCUCAG | 37449 |
| RNACS4 926 | hPKU5 R20 P10 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUCCCGCGGCCCUUCUCAG | 37450 |
| RNACS4 927 | hPKU5 R20 P10 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUACCUCGCCCCUUCUCAG | 37451 |
| RNACS4 928 | hPKU5 R20 P10 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACGAUACCUCGGCCCUUCUCAG | 37452 |
| RNACS4 929 | hPKU5 R18 P10 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGGCCCUUCUCAG | 37453 |
| RNACS4 930 | hPKU5 R18 P10 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGGCCCUUCUCAG | 37454 |
| RNACS4 931 | hPKU5 R18 P10 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUCCCUCGGCCCUUCUCAG | 37455 |
| RNACS4 932 | hPKU5 R18 P10 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUCCCGCGGCCCUUCUCAG | 37456 |
| RNACS4 933 | hPKU5 R18 P10 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGCCCCUUCUCAG | 37457 |

TABLE E6A-continued

| Table E6 Sequences without Chemical Modifications | | | |
|---|---|---|---|
| RNACS# | Name | IDT Notation | SEQ ID NO |
| RNACS4 934 | hPKU5 R18 P10 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACGAUACCUCGGCCCUUCUCAG | 37458 |
| RNACS4 935 | hPKU5 R16 P10 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUACCUCGGCCCUUCUCAG | 37459 |
| RNACS4 936 | hPKU5 R16 P10 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUACCGCGGCCCUUCUCAG | 37460 |
| RNACS4 937 | hPKU5 R16 P10 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUCCCUCGGCCCUUCUCAG | 37461 |
| RNACS4 938 | hPKU5 R16 P10 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUCCCGCGGCCCUUCUCAG | 37462 |
| RNACS4 939 | hPKU5 R16 P10 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUACCUCGCCCCUUCUCAG | 37463 |
| RNACS4 940 | hPKU5 R16 P10 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACGAUACCUCGGCCCUUCUCAG | 37464 |
| RNACS4 941 | hPKU5 R14 P10 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUACCUCGGCCCUUCUCAG | 37465 |
| RNACS4 942 | hPKU5 R14 P10 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUACCGCGGCCCUUCUCAG | 37466 |
| RNACS4 943 | hPKU5 R14 P10 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUCCCUCGGCCCUUCUCAG | 37467 |
| RNACS4 944 | hPKU5 R14 P10 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUCCCGCGGCCCUUCUCAG | 37468 |
| RNACS4 945 | hPKU5 R14 P10 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUACCUCGCCCCUUCUCAG | 37469 |
| RNACS4 946 | hPKU5 R14 P10 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACGAUACCUCGGCCCUUCUCAG | 37470 |
| RNACS4 947 | hPKU5 R12 P10 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUACCUCGGCCCUUCUCAG | 37471 |
| RNACS4 948 | hPKU5 R12 P10 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUACCGCGGCCCUUCUCAG | 37472 |
| RNACS4 949 | hPKU5 R12 P10 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUCCCUCGGCCCUUCUCAG | 37473 |
| RNACS4 950 | hPKU5 R12 P10 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUCCCGCGGCCCUUCUCAG | 37474 |
| RNACS4 951 | hPKU5 R12 P10 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUACCUCGCCCCUUCUCAG | 37475 |
| RNACS4 952 | hPKU5 R12 P10 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACGAUACCUCGGCCCUUCUCAG | 37476 |
| RNACS4 953 | hPKU5 R20 P9 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUACCUCGGCCCUUCUCA | 37477 |
| RNACS4 954 | hPKU5 R20 P9 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUACCGCGGCCCUUCUCA | 37478 |
| RNACS4 955 | hPKU5 R20 P9 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUCCCUCGGCCCUUCUCA | 37479 |
| RNACS4 956 | hPKU5 R20 P9 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUCCCGCGGCCCUUCUCA | 37480 |
| RNACS4 957 | hPKU5 R20 P9 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUACCUCGCCCCUUCUCA | 37481 |
| RNACS4 958 | hPKU5 R20 P9 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACGAUACCUCGGCCCUUCUCA | 37482 |

TABLE E6A-continued

Table E6 Sequences without Chemical Modifications

| RNACS# | Name | IDT Notation | SEQ ID NO |
|---|---|---|---|
| RNACS4 959 | hPKU5 R18 P9 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGGCCCUUCUCA | 37483 |
| RNACS4 960 | hPKU5 R18 P9 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGGCCCUUCUCA | 37484 |
| RNACS4 961 | hPKU5 R18 P9 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUCCCUCGGCCCUUCUCA | 37485 |
| RNACS4 962 | hPKU5 R18 P9 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUCCCGCGGCCCUUCUCA | 37486 |
| RNACS4 963 | hPKU5 R18 P9 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGCCCCUUCUCA | 37487 |
| RNACS4 964 | hPKU5 R18 P9 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACGAUACCUCGGCCCUUCUCA | 37488 |
| RNACS4 965 | hPKU5 R16 P9 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUACCUCGGCCCUUCUCA | 37489 |
| RNACS4 966 | hPKU5 R16 P9 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUACCGCGGCCCUUCUCA | 37490 |
| RNACS4 967 | hPKU5 R16 P9 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUCCCUCGGCCCUUCUCA | 37491 |
| RNACS4 968 | hPKU5 R16 P9 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUCCCGCGGCCCUUCUCA | 37492 |
| RNACS4 969 | hPKU5 R16 P9 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUACCUCGCCCCUUCUCA | 37493 |
| RNACS4 970 | hPKU5 R16 P9 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACGAUACCUCGGCCCUUCUCA | 37494 |
| RNACS4 971 | hPKU5 R14 P9 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUACCUCGGCCCUUCUCA | 37495 |
| RNACS4 972 | hPKU5 R14 P9 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUACCGCGGCCCUUCUCA | 37496 |
| RNACS4 973 | hPKU5 R14 P9 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUCCCUCGGCCCUUCUCA | 37497 |
| RNACS4 974 | hPKU5 R14 P9 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUCCCGCGGCCCUUCUCA | 37498 |
| RNACS4 975 | hPKU5 R14 P9 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUACCUCGCCCCUUCUCA | 37499 |
| RNACS4 976 | hPKU5 R14 P9 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACGAUACCUCGGCCCUUCUCA | 37500 |
| RNACS4 977 | hPKU5 R12 P9 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUACCUCGGCCCUUCUCA | 37501 |
| RNACS4 978 | hPKU5 R12 P9 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUACCGCGGCCCUUCUCA | 37502 |
| RNACS4 979 | hPKU5 R12 P9 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUCCCUCGGCCCUUCUCA | 37503 |
| RNACS4 980 | hPKU5 R12 P9 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUCCCGCGGCCCUUCUCA | 37504 |
| RNACS4 981 | hPKU5 R12 P9 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUACCUCGCCCCUUCUCA | 37505 |
| RNACS4 982 | hPKU5 R12 P9 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACGAUACCUCGGCCCUUCUCA | 37506 |
| RNACS4 983 | hPKU5 R20 P8 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUACCUCGGCCCUUCUC | 37507 |

TABLE E6A-continued

Table E6 Sequences without Chemical Modifications

| RNACS# | Name | IDT Notation | SEQ ID NO |
|---|---|---|---|
| RNACS4 984 | hPKU5 R20 P8 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUACCGCGGCCCUUCUC | 37508 |
| RNACS4 985 | hPKU5 R20 P8 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUCCCUCGGCCCUUCUC | 37509 |
| RNACS4 986 | hPKU5 R20 P8 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUCCCGCGGCCCUUCUC | 37510 |
| RNACS4 987 | hPKU5 R20 P8 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACAAUACCUCGCCCCUUCUC | 37511 |
| RNACS4 988 | hPKU5 R20 P8 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUUGCUGCCACGAUACCUCGGCCCUUCUC | 37512 |
| RNACS4 989 | hPKU5 R18 P8 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGGCCCUUCUC | 37513 |
| RNACS4 990 | hPKU5 R18 P8 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUACCGCGGCCCUUCUC | 37514 |
| RNACS4 991 | hPKU5 R18 P8 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUCCCUCGGCCCUUCUC | 37515 |
| RNACS4 992 | hPKU5 R18 P8 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUCCCGCGGCCCUUCUC | 37516 |
| RNACS4 993 | hPKU5 R18 P8 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACAAUACCUCGCCCCUUCUC | 37517 |
| RNACS4 994 | hPKU5 R18 P8 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCGCUGCCACGAUACCUCGGCCCUUCUC | 37518 |
| RNACS4 995 | hPKU5 R16 P8 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUACCUCGGCCCUUCUC | 37519 |
| RNACS4 996 | hPKU5 R16 P8 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUACCGCGGCCCUUCUC | 37520 |
| RNACS4 997 | hPKU5 R16 P8 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUCCCUCGGCCCUUCUC | 37521 |
| RNACS4 998 | hPKU5 R16 P8 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUCCCGCGGCCCUUCUC | 37522 |
| RNACS4 999 | hPKU5 R16 P8 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACAAUACCUCGCCCCUUCUC | 37523 |
| RNACS5 000 | hPKU5 R16 P8 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCUGCCACGAUACCUCGGCCCUUCUC | 37524 |
| RNACS5 001 | hPKU5 R14 P8 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUACCUCGGCCCUUCUC | 37525 |
| RNACS5 002 | hPKU5 R14 P8 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUACCGCGGCCCUUCUC | 37526 |
| RNACS5 003 | hPKU5 R14 P8 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUCCCUCGGCCCUUCUC | 37527 |
| RNACS5 004 | hPKU5 R14 P8 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUCCCGCGGCCCUUCUC | 37528 |
| RNACS5 005 | hPKU5 R14 P8 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACAAUACCUCGCCCCUUCUC | 37529 |
| RNACS5 006 | hPKU5 R14 P8 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCCCACGAUACCUCGGCCCUUCUC | 37530 |
| RNACS5 007 | hPKU5 R12 P8 sub0 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUACCUCGGCCCUUCUC | 37531 |
| RNACS5 008 | hPKU5 R12 P8 sub1 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUACCGCGGCCCUUCUC | 37532 |

TABLE E6A-continued

| Table E6 Sequences without Chemical Modifications | | | |
|---|---|---|---|
| RNACS# | Name | IDT Notation | SEQ ID NO |
| RNACS5 009 | hPKU5 R12 P8 sub2 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUCCCUCGGCCCUUCUC | 37533 |
| RNACS5 010 | hPKU5 R12 P8 sub3 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUCCCGCGGCCCUUCUC | 37534 |
| RNACS5 011 | hPKU5 R12 P8 sub4 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACAAUACCUCGCCCCUUCUC | 37535 |
| RNACS5 012 | hPKU5 R12 P8 sub7 | UAGCGAACUGAGAAGGGCCAGUUUUAGAGCUAGAAAUAGCAAGUUAAAAUAAGGCUAGUCCGUUAUCAACUUG AAAAAGUGGCACCGAGUCGGUGCACGAUACCUCGGCCCUUCUC | 37536 |
| RNACS5 013 | hPKU6 R20 P11 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAAGGGCCGAGGUAUUGUGGCAG | 37537 |
| RNACS5 014 | hPKU6 R20 P11 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAAGGGCCGGGGUAUUGUGGCAG | 37538 |
| RNACS5 015 | hPKU6 R20 P11 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAACGGCCGGGGUAUUGUGGCAG | 37539 |
| RNACS5 016 | hPKU6 R20 P11 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAACGGACGGGGUAUUGUGGCAG | 37540 |
| RNACS5 017 | hPKU6 R20 P11 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAAGGGCCGCGGUAUUGUGGCAG | 37541 |
| RNACS5 018 | hPKU6 R20 P11 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAAGGGACGCGGUAUUGUGGCAG | 37542 |
| RNACS5 019 | hPKU6 R18 P11 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAAGGGCCGAGGUAUUGUGGCAG | 37543 |
| RNACS5 020 | hPKU6 R18 P11 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAAGGGCCGGGGUAUUGUGGCAG | 37544 |
| RNACS5 021 | hPKU6 R18 P11 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAACGGCCGGGGUAUUGUGGCAG | 37545 |
| RNACS5 022 | hPKU6 R18 P11 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAACGGACGGGGUAUUGUGGCAG | 37546 |
| RNACS5 023 | hPKU6 R18 P11 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAAGGGCCGCGGUAUUGUGGCAG | 37547 |
| RNACS5 024 | hPKU6 R18 P11 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAAGGGACGCGGUAUUGUGGCAG | 37548 |
| RNACS5 025 | hPKU6 R16 P11 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGCCGAGGUAUUGUGGCAG | 37549 |
| RNACS5 026 | hPKU6 R16 P11 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGCCGGGGUAUUGUGGCAG | 37550 |
| RNACS5 027 | hPKU6 R16 P11 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAACGGCCGGGGUAUUGUGGCAG | 37551 |
| RNACS5 028 | hPKU6 R16 P11 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAACGGACGGGGUAUUGUGGCAG | 37552 |
| RNACS5 029 | hPKU6 R16 P11 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGCCGCGGUAUUGUGGCAG | 37553 |
| RNACS5 030 | hPKU6 R16 P11 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGACGCGGUAUUGUGGCAG | 37554 |
| RNACS5 031 | hPKU6 R14 P11 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGCCGAGGUAUUGUGGCAG | 37555 |
| RNACS5 032 | hPKU6 R14 P11 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGCCGGGGUAUUGUGGCAG | 37556 |
| RNACS5 033 | hPKU6 R14 P11 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAACGGCCGGGGUAUUGUGGCAG | 37557 |

TABLE E6A-continued

Table E6 Sequences without Chemical Modifications

| RNACS# | Name | IDT Notation | SEQ ID NO |
|---|---|---|---|
| RNACS5 034 | hPKU6 R14 P11 sub5 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGAGAACGGACGGGGUAUUGUGGCAG | 37558 |
| RNACS5 035 | hPKU6 R14 P11 sub6 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGAGAAGGGCCGCGGUAUUGUGGCAG | 37559 |
| RNACS5 036 | hPKU6 R14 P11 sub7 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGAGAAGGGACGCGGUAUUGUGGCAG | 37560 |
| RNACS5 037 | hPKU6 R12 P11 sub0 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGAAGGGCCGAGGUAUUGUGGCAG | 37561 |
| RNACS5 038 | hPKU6 R12 P11 sub1 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGAAGGGCCGGGGUAUUGUGGCAG | 37562 |
| RNACS5 039 | hPKU6 R12 P11 sub4 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGAACGGCCGGGGUAUUGUGGCAG | 37563 |
| RNACS5 040 | hPKU6 R12 P11 sub5 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGAACGGACGGGGUAUUGUGGCAG | 37564 |
| RNACS5 041 | hPKU6 R12 P11 sub6 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGAAGGGCCGCGGUAUUGUGGCAG | 37565 |
| RNACS5 042 | hPKU6 R12 P11 sub7 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCGAAGGGACGCGGUAUUGUGGCAG | 37566 |
| RNACS5 043 | hPKU6 R20 P10 sub0 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCGAACUGAGAAGGGCCGAGGUAUUGUGGCA | 37567 |
| RNACS5 044 | hPKU6 R20 P10 sub1 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCGAACUGAGAAGGGCCGGGGUAUUGUGGCA | 37568 |
| RNACS5 045 | hPKU6 R20 P10 sub4 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCGAACUGAGAACGGCCGGGGUAUUGUGGCA | 37569 |
| RNACS5 046 | hPKU6 R20 P10 sub5 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCGAACUGAGAACGGACGGGGUAUUGUGGCA | 37570 |
| RNACS5 047 | hPKU6 R20 P10 sub6 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCGAACUGAGAAGGGCCGCGGUAUUGUGGCA | 37571 |
| RNACS5 048 | hPKU6 R20 P10 sub7 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCGAACUGAGAAGGGACGCGGUAUUGUGGCA | 37572 |
| RNACS5 049 | hPKU6 R18 P10 sub0 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAACUGAGAAGGGCCGAGGUAUUGUGGCA | 37573 |
| RNACS5 050 | hPKU6 R18 P10 sub1 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAACUGAGAAGGGCCGGGGUAUUGUGGCA | 37574 |
| RNACS5 051 | hPKU6 R18 P10 sub4 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAACUGAGAACGGCCGGGGUAUUGUGGCA | 37575 |
| RNACS5 052 | hPKU6 R18 P10 sub5 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAACUGAGAACGGACGGGGUAUUGUGGCA | 37576 |
| RNACS5 053 | hPKU6 R18 P10 sub6 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAACUGAGAAGGGCCGCGGUAUUGUGGCA | 37577 |
| RNACS5 054 | hPKU6 R18 P10 sub7 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCAACUGAGAAGGGACGCGGUAUUGUGGCA | 37578 |
| RNACS5 055 | hPKU6 R16 P10 sub0 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCUGAGAAGGGCCGAGGUAUUGUGGCA | 37579 |
| RNACS5 056 | hPKU6 R16 P10 sub1 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCUGAGAAGGGCCGGGGUAUUGUGGCA | 37580 |
| RNACS5 057 | hPKU6 R16 P10 sub4 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCUGAGAACGGCCGGGGUAUUGUGGCA | 37581 |
| RNACS5 058 | hPKU6 R16 P10 sub5 | ACUUUGCUGCCACAAUACCUGUUUUAGAGCUAGAAAUAGCAAGUUAAAAUAAGGCUAGUCCGUUAUCAACUUGAAAAAGUGGCACCGAGUCGGUGCCUGAGAACGGACGGGGUAUUGUGGCA | 37582 |

TABLE E6A-continued

| Table E6 Sequences without Chemical Modifications | | | |
|---|---|---|---|
| RNACS# | Name | IDT Notation | SEQ ID NO |
| RNACS5 059 | hPKU6 R16 P10 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGCCGCGGUAUUGUGGCA | 37583 |
| RNACS5 060 | hPKU6 R16 P10 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGACGCGGUAUUGUGGCA | 37584 |
| RNACS5 061 | hPKU6 R14 P10 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGCCGAGGUAUUGUGGCA | 37585 |
| RNACS5 062 | hPKU6 R14 P10 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGCCGGGGUAUUGUGGCA | 37586 |
| RNACS5 063 | hPKU6 R14 P10 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAACGGCCGGGGUAUUGUGGCA | 37587 |
| RNACS5 064 | hPKU6 R14 P10 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAACGGACGGGGUAUUGUGGCA | 37588 |
| RNACS5 065 | hPKU6 R14 P10 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGCCGCGGUAUUGUGGCA | 37589 |
| RNACS5 066 | hPKU6 R14 P10 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGACGCGGUAUUGUGGCA | 37590 |
| RNACS5 067 | hPKU6 R12 P10 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAAGGGCCGAGGUAUUGUGGCA | 37591 |
| RNACS5 068 | hPKU6 R12 P10 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAAGGGCCGGGGUAUUGUGGCA | 37592 |
| RNACS5 069 | hPKU6 R12 P10 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAACGGCCGGGGUAUUGUGGCA | 37593 |
| RNACS5 070 | hPKU6 R12 P10 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAACGGACGGGGUAUUGUGGCA | 37594 |
| RNACS5 071 | hPKU6 R12 P10 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAAGGGCCGCGGUAUUGUGGCA | 37595 |
| RNACS5 072 | hPKU6 R12 P10 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAAGGGACGCGGUAUUGUGGCA | 37596 |
| RNACS5 073 | hPKU6 R20 P9 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAAGGGCCGAGGUAUUGUGGC | 37597 |
| RNACS5 074 | hPKU6 R20 P9 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAAGGGCCGGGGUAUUGUGGC | 37598 |
| RNACS5 075 | hPKU6 R20 P9 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAACGGCCGGGGUAUUGUGGC | 37599 |
| RNACS5 076 | hPKU6 R20 P9 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAACGGACGGGGUAUUGUGGC | 37600 |
| RNACS5 077 | hPKU6 R20 P9 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAAGGGCCGCGGUAUUGUGGC | 37601 |
| RNACS5 078 | hPKU6 R20 P9 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCGAACUGAGAAGGGACGCGGUAUUGUGGC | 37602 |
| RNACS5 079 | hPKU6 R18 P9 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAAGGGCCGAGGUAUUGUGGC | 37603 |
| RNACS5 080 | hPKU6 R18 P9 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAAGGGCCGGGGUAUUGUGGC | 37604 |
| RNACS5 081 | hPKU6 R18 P9 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAACGGCCGGGGUAUUGUGGC | 37605 |
| RNACS5 082 | hPKU6 R18 P9 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAACGGACGGGGUAUUGUGGC | 37606 |
| RNACS5 083 | hPKU6 R18 P9 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAAGGGCCGCGGUAUUGUGGC | 37607 |

TABLE E6A-continued

Table E6 Sequences without Chemical Modifications

| RNACS# | Name | IDT Notation | SEQ ID NO |
|---|---|---|---|
| RNACS5 084 | hPKU6 R18 P9 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCAACUGAGAAGGGACGCGGUAUUGUGGC | 37608 |
| RNACS5 085 | hPKU6 R16 P9 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGCCGAGGUAUUGUGGC | 37609 |
| RNACS5 086 | hPKU6 R16 P9 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGCCGGGGUAUUGUGGC | 37610 |
| RNACS5 087 | hPKU6 R16 P9 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAACGGCCGGGGUAUUGUGGC | 37611 |
| RNACS5 088 | hPKU6 R16 P9 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAACGGACGGGGUAUUGUGGC | 37612 |
| RNACS5 089 | hPKU6 R16 P9 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGCCGCGGUAUUGUGGC | 37613 |
| RNACS5 090 | hPKU6 R16 P9 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCCUGAGAAGGGACGCGGUAUUGUGGC | 37614 |
| RNACS5 091 | hPKU6 R14 P9 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGCCGAGGUAUUGUGGC | 37615 |
| RNACS5 092 | hPKU6 R14 P9 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGCCGGGGUAUUGUGGC | 37616 |
| RNACS5 093 | hPKU6 R14 P9 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAACGGCCGGGGUAUUGUGGC | 37617 |
| RNACS5 094 | hPKU6 R14 P9 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAACGGACGGGGUAUUGUGGC | 37618 |
| RNACS5 095 | hPKU6 R14 P9 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGCCGCGGUAUUGUGGC | 37619 |
| RNACS5 096 | hPKU6 R14 P9 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAGAAGGGACGCGGUAUUGUGGC | 37620 |
| RNACS5 097 | hPKU6 R12 P9 sub0 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAAGGGCCGAGGUAUUGUGGC | 37621 |
| RNACS5 098 | hPKU6 R12 P9 sub1 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAAGGGCCGGGGUAUUGUGGC | 37622 |
| RNACS5 099 | hPKU6 R12 P9 sub4 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAACGGCCGGGGUAUUGUGGC | 37623 |
| RNACS5 100 | hPKU6 R12 P9 sub5 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAACGGACGGGGUAUUGUGGC | 37624 |
| RNACS5 101 | hPKU6 R12 P9 sub6 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAAGGGCCGCGGUAUUGUGGC | 37625 |
| RNACS5 102 | hPKU6 R12 P9 sub7 | ACUUUGCUGCCACAAUACCUGUUUUAGAGCUAGAAAUAGCAAGUUAAAAUAAGGCUAGUCCGUUAUCAACUUGA AAAAGUGGCACCGAGUCGGUGCGAAGGGACGCGGUAUUGUGGC | 37626 |

The gene modifying system comprising mRNA encoding the gene modifying polypeptide listed above and a template RNA listed above were transfected into human hepatoblasts differentiated from CRISPR-edited iPSCs containing the R408W mutation in the human PAH gene. Briefly PAH iPSCs are dissociated into single cells and then replated onto Geltex-coated plates. The iPSCs were then differentiated into definitive endoderm cells by treatment with Activin A, FGF2, and ChIR for 7 days. Definitive endoderm cells are then further patterned into foregut endoderm cells by activation of the BMP4 and FGF2 signaling pathway for an additional 6 days. Lastly, foregut endoderm cells were patterned into hepatoblast cells by treatment with oncostamin M, dexamethasone, hepatocyte growth factors, and ChIR for 12 days. Hepatoblasts were then sub-cultured onto collagen1-coated plates and expanded in media containing FGF19, Dexamethazone, ChIR, and SB431542 prior to transfection. The gene modifying polypeptide and template RNA were delivered by nucleofection in the RNA format. Specifically, 4 μg of gene modifying polypeptide mRNA were combined with 10 μg of chemically synthesized template RNA, in 5 μL of water. The transfection mix was added to 100,000 iPSCs in Buffer P3 [Lonza], and cells were nucleofected using program DG-138. After nucleofection, cells were grown at 37° C., 5% $CO_2$ for 3 days prior to cell lysis and genomic DNA extraction. To analyze gene editing activity, primers flanking the target insertion site locus were used to amplify across the locus. Amplicons were analyzed via short read sequencing using an Illumina MiSeq. Conversion of T>C indicates successful editing.

Figures 31A, 31B:
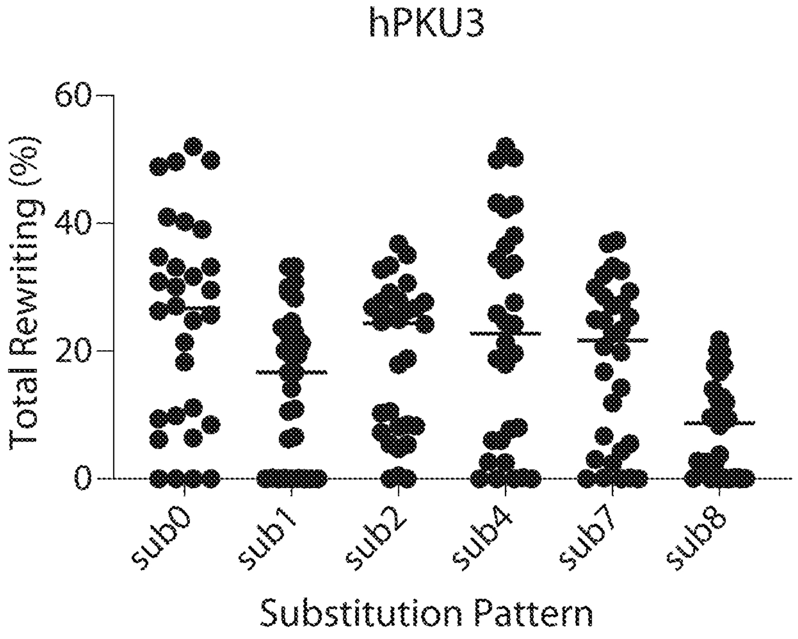
FIGS. 31A-31B are a graph stratified by silent substitution (FIG. 31A) showing percent total rewriting following mRNA delivery of various gene modifying systems utilizing the hPKU3 template RNAs comprising various silent substitutions into human iPSC-derived hepatoblasts and a chart (FIG. 31B) showing the particular silent substitutions utilized in FIG. 31A.

As shown by FIG. 31A, treating hepatoblasts with gene modifying systems comprising exemplary hPKU3 template RNAs comprising a variety of silent substitutions (FIG. 31B) resulted in editing at the target locus. The results show that silent substitution 4 (sub4) resulted in comparable rewriting % as the template RNA without silent substitutions, whereas other silent substitutions resulted in lower rewriting %.

Figures 32A, 32B:
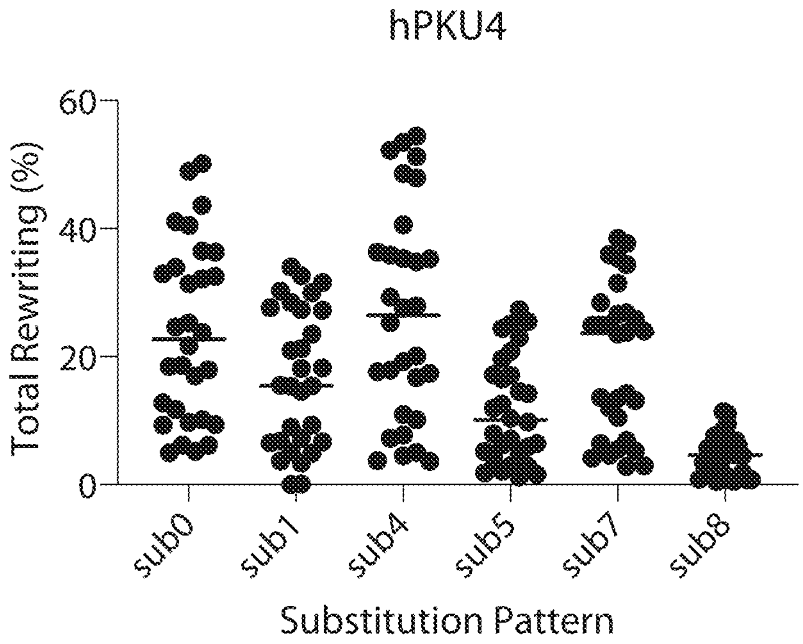
FIGS. 32A-32B are a graph stratified by silent substitution (FIG. 32A) showing percent total rewriting following mRNA delivery of various gene modifying systems utilizing the hPKU4 template RNAs comprising various silent substitutions into human iPSC-derived hepatoblasts and a chart (FIG. 32B) showing the particular silent substitutions utilized in FIG. 32A.

As shown by FIG. 32A, treating hepatoblasts with gene modifying systems comprising exemplary hPKU4 template RNAs comprising a variety of silent substitutions (FIG. 32B) resulted in editing at the target locus. The results show that silent substitution 4 (sub4) resulted in comparable or higher rewriting % as the template RNA without silent substitutions, whereas other silent substitutions resulted in lower rewriting %.

Figures 33A, 33B:
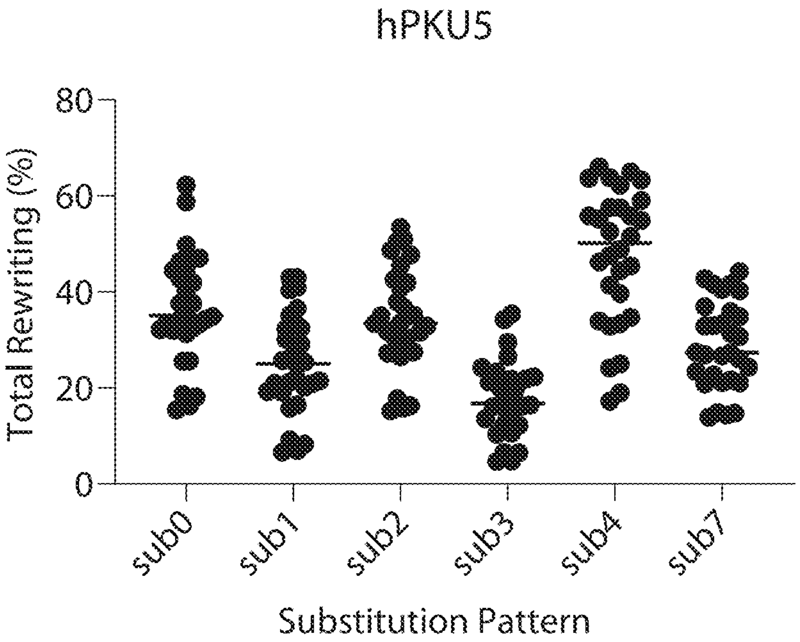
FIGS. 33A-33B are a graph (33A) and a chart (33B) showing are a graph stratified by silent substitution (FIG. 33A) showing percent total rewriting following mRNA delivery of various gene modifying systems utilizing the hPKU5 template RNAs comprising various silent substitutions into human iPSC-derived hepatoblasts and a chart (FIG. 33B) showing the particular silent substitutions utilized in FIG. 33A.

As shown by FIG. 33A, treating hepatoblasts with gene modifying systems comprising exemplary hPKU5 template RNAs comprising a variety of silent substitutions (FIG. 33B) resulted in editing at the target locus. The results show that silent substitution 4 (sub4) resulted in comparable or higher rewriting % as the template RNA without silent substitutions, whereas other silent substitutions resulted in lower rewriting %.

Figures 34A, 34B:
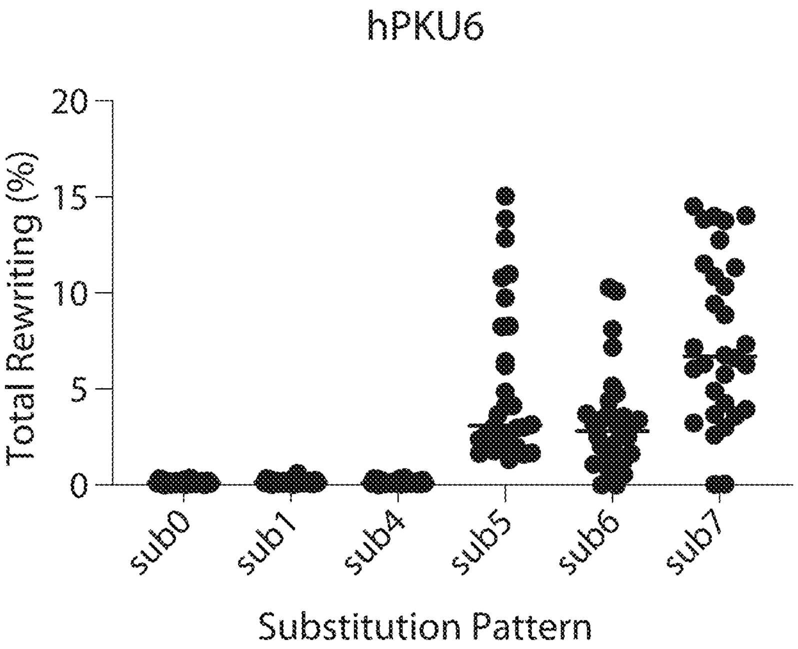
FIGS. 34A-34B are a graph stratified by silent substitution (FIG. 34A) showing percent total rewriting following mRNA delivery of various gene modifying systems utilizing the hPKU6 template RNAs comprising various silent substitutions into human iPSC-derived hepatoblasts and a chart (FIG. 34B) showing the particular silent substitutions utilized in FIG. 34A.

As shown by FIG. 34A, treating hepatoblasts with gene modifying systems comprising exemplary hPKU6 template RNAs comprising a variety of silent substitutions (FIG. 34B) resulted in editing at the target locus. The results show that silent substitutions 5, 6, and 7 (sub5, sub6, and sub7, respectively) resulted in much higher rewriting % as the template RNA without silent substitutions, which had a very low rewriting %. These results demonstrate that silent substitutions can rescue the low rewriting activity of exemplary hPKU6 template RNAs.

Taken together, these results demonstrate that silent substitutions can increase the rewriting activity of exemplary template RNAs that target a therapeutically relevant human locus, and in some cases rescue otherwise low rewriting activity.

It should be understood that for all numerical bounds describing some parameter in this application, such as "about," "at least," "less than," and "more than," the description also necessarily encompasses any range bounded by the recited values. Accordingly, for example, the description "at least 1, 2, 3, 4, or 5" also describes, inter alia, the ranges 1-2, 1-3, 1-4, 1-5, 2-3, 2-4, 2-5, 3-4, 3-5, and 4-5, et cetera.

For all patents, applications, or other reference cited herein, such as non-patent literature and reference sequence information, it should be understood that they are incorporated by reference in their entirety for all purposes as well as for the proposition that is recited. Where any conflict exists between a document incorporated by reference and the present application, this application will control. All information associated with reference gene sequences disclosed in this application, such as GeneIDs or accession numbers (typically referencing NCBI accession numbers), including, for example, genomic loci, genomic sequences, functional annotations, allelic variants, and reference mRNA (including, e.g., exon boundaries or response elements) and protein sequences (such as conserved domain structures), as well as chemical references (e.g., PubChem compound, PubChem substance, or PubChem Bioassay entries, including the annotations therein, such as structures and assays, et cetera), are hereby incorporated by reference in their entirety.

Headings used in this application are for convenience only and do not affect the interpretation of this application.

LENGTHY TABLES

The patent contains a lengthy table section. A copy of the table is available in electronic form from the USPTO web site (https://seqdata.uspto.gov/docdetail?docId=US12544458B2). An electronic copy of the table will also be available from the USPTO upon request and payment of the fee set forth in 37 CFR 1.19(b)(3).

SEQUENCE LISTING (37665 sequences)

SEQ ID NO: 1 - protein, 2133 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 2 - protein, 2112 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 3 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 4 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 5 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 6 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 8 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 9 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 10 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 11 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 12 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 13 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 14 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 15 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 16 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 17 - protein, 1998 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFERALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTLVLGAWLQPDPVPSYALLYKSLLRHPAIVVGHVRSHSSASHPIASLNNYVDQLAGKRTADGSEFEKRTADGSEFESPKKKAKVE

SEQ ID NO: 18 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGWVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 19 - protein, 2114 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGSGGWVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 20 - protein, 2114 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGWVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 21 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 22 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 23 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 24 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 25 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 26 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 27 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 28 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 29 - protein, 2113 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 30 - protein, 2111 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 31 - protein, 2114 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 32 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGLTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAIPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKGDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINTAGKRTADGSEFEKRTADGSEFESPKKKAKVE

SEQ ID NO: 33 - protein, 2008 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGLTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAPPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKPDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINTAGKRTADGSEFEKRTADGSEFESPKKKAKVE

SEQ ID NO: 34 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 35 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 36 - protein, 2123 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 37 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 38 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 39 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 40 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 41 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 42 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 43 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 44 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 45 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 46 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 47 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 48 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 49 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 50 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 51 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 52 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 53 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 54 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 55 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 56 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 57 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 58 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 59 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 60 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 61 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 62 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 63 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 64 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 65 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 66 - protein, 2081 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 67 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 68 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 69 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 70 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 71 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 72 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 73 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 74 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 75 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 76 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 77 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 78 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 79 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 80 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 81 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 82 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 83 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 84 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 85 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 86 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 87 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 88 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 89 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 90 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 91 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 92 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 93 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 94 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 95 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 96 - protein, 2104 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 97 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 98 - protein, 2125 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 99 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 100 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 101 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 102 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 103 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 104 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 105 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 106 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 107 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 108 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 109 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 110 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 111 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 112 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 113 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 114 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 115 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 116 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 117 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 118 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 119 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 120 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 121 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 122 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 123 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 124 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 125 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 126 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 127 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 128 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 129 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 130 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 131 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 132 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

(The sequence listing continues in the following parts.)

The invention claimed is:

1. A template RNA comprising, from 5' to 3':

a) a gRNA spacer that is complementary to a first portion of a human PAH gene, wherein the gRNA spacer comprises an RNA sequence of nucleotides 1 to 20 of SEQ ID NO: 37,221;

b) a gRNA scaffold that binds a SpyCas9 domain;

c) a heterologous object sequence comprising a mutation region to correct a mutation in a second portion of the human PAH gene, wherein the heterologous object sequence comprises a nucleotide sequence of nucleotides 97 to 105 of SEQ ID NO: 37,221; and d) a primer binding site (PBS) sequence comprising at least 3 bases with 100% identity to a third portion of the human PAH gene, wherein the PBS sequence comprises a nucleotide sequence of nucleotides 106 to 116 of SEQ ID NO: 37,221.

2. The template RNA of claim 1, wherein the mutation to be corrected in the human PAH gene is R408W.

3. The template RNA of claim 1, wherein the gRNA spacer has a length of 20 nucleotides.

4. The template RNA of claim 1, wherein the heterologous object sequence has a length of 9-16 nucleotides.

5. The template RNA of claim 1, wherein the heterologous object sequence comprises, from 5' to 3', a post-edit homology region, a mutation region, and a pre-edit homology region.

6. The template RNA of claim 1, wherein the heterologous object sequence consists of an RNA sequence of GGGCCGAGG.

7. The template RNA of claim 1, wherein the PBS sequence has a length of 11-12 nucleotides.

8. The template RNA of claim 1, wherein the PBS sequence consists of an RNA sequence of 106 to 116 of SEO ID NO: 37,221.

9. The template RNA of claim 1, wherein the gRNA scaffold comprises an RNA sequence having at least 90% identity to nucleotides 21 to 96 of SEQ ID NO: 37,221.

10. The template RNA of claim 1, wherein the gRNA scaffold comprises an RNA sequence of nucleotides 21 to 96 of SEQ ID NO: 37,221.

11. The template RNA of claim 1, which comprises an RNA sequence having at least 90% identity to SEQ ID NO: 37,221.

12. The template RNA of claim 1, which comprises an RNA sequence of SEQ ID NO: 37,221.

13. The template RNA of claim 1, which comprises one or more chemically modified nucleotides.

14. The template RNA of claim 13, which comprises the RNA sequence and chemical modifications of SEQ ID NO: 30,500.

15. A gene modifying system comprising:

a template RNA of claim 1, and a gene modifying polypeptide comprising a SpyCas9 nickase domain, or a nucleic acid encoding the gene modifying polypeptide.

16. The gene modifying system of claim 15, which comprises the nucleic acid encoding the gene modifying polypeptide, wherein the nucleic acid comprises RNA.

17. The gene modifying system of claim 15, wherein the gene modifying polypeptide comprises:

a reverse transcriptase (RT) domain;

a SpyCas9 nickase domain; and a linker disposed between the RT domain and the SpyCas9 nickase domain.

18. The gene modifying system of claim 17, wherein the RT domain is an RT domain from a murine leukemia virus (MMLV), a porcine endogenous retrovirus (PERV), an Avian reticuloendotheliosis virus (AVIRE), a feline leukemia virus (FLV), a simian foamy virus (SFV), a bovine leukemia virus (BLV), a Mason-Pfizer monkey virus (MPMV), a human foamy virus (HFV), or a bovine foamy/syncytial virus (BFV/BSV).

19. The gene modifying system of claim 18, wherein the simian foamy virus is a SFV3L.

20. The gene modifying system of claim 17, which further comprises a second strand-targeting gRNA spacer that directs a second nick to a second strand of the human PAH gene.

21. A pharmaceutical composition, comprising the gene modifying system of claim 15 and a pharmaceutically acceptable excipient or carrier.

22. The pharmaceutical composition of claim 21, wherein the pharmaceutically acceptable excipient or carrier is selected from the group consisting of a plasmid vector, a viral vector, a vesicle, and a lipid nanoparticle.

23. A method for modifying a target site in the human PAH gene in a cell, the method comprising contacting the cell with the gene modifying system of claim 15, or DNA encoding the same, thereby modifying the target site in the human PAH gene in a cell.

24. A method for treating a subject having phenylketonuria (PKU) or hyperphenylalaninemia, the method comprising administering to the subject the gene modifying system of claim 15 thereby treating the subject havingPKU or hyperphenylalaninemia.

25. A method of making the template RNA of claim 1, the method comprising synthesizing the template RNA by in vitro transcription, solid-phase synthesis, or by introducing a DNA encoding the template RNA into a host cell under conditions that allow for production of the template RNA.

26. A template RNA comprising a sequence having at least 90% identity to SEQ ID NO: 37221.

27. The template RNA of claim 26, which comprises a sequence having at least 95% identity to SEQ ID NO: 37221.

28. The template RNA of claim 26, which comprises a sequence having at least 99% identity to SEQ ID NO: 37221.

* * * * *